United States Patent 10,570,408 (TRANSGENIC PLANTS WITH ENHANCED AGRONOMIC TRAITS) - sequence listing, part 7

SEQ ID NO: 27187 - protein, 307 aa, Synechococcus elongatus
MVTQDIPAVDIGFTHEDFAALLDQYDYHFNPGDTVVGTVFNLEPRGALIDIGAKTAAFLPVQEMSINRVESPEEVLQPSEMREFFILSDENEDGQLTLSIRRIEYMRAWERVRQLQTEDATVRSEVFATNRGGALVRIEGLRGFIPGSHISTRKAKEDLVGEELPLKFLEVDEDRNRLVLSHRRALVERKMNRLEVGEVVVGAVRGIKPYGAFIDIGGVSGLLHISEISHDHIETPHSVFNVNDEVKVMIIDLDAERGRISLSTKQLEPEPGDMVRNPEVVYEKAEEMAAQYREKLKQQAEGLVVTE

SEQ ID NO: 27188 - protein, 259 aa, Solanum demissum
MGRFDKEGLKKGPWTPEEDQKLLSFIDKHGCGSWRALPAKAGLQRCGKSCRLRWINYLRPDIKRGKFSLQEERTIIQLHALLGNRWSAIAAYLPSRTDNEIKNYWNSCLKKSHMAEWESARLEAEARLVQKSKILFHNNNSHNYNINPSTVSQQLPYYQQLPCLDILKAWQMTSTKLPTINDISHAILRNNSKNKKLDSSIPSSTLNSSENIFANNAPTTKVGDDHQNLHNLSTINSCFEDDHLQTELPSFMQEFSGFY

SEQ ID NO: 27189 - protein, 254 aa, Rhizobium leguminosarum
MIFDRFRLNGQVALVTGGTRGIGLAIAEALGEAGAKVIITGRTRNAAAEDRLSRAGVDCDFVAADLMKESAADELVTETLSRAGRLDILVNNAGIAIHGDSGEFSDAIWREIMTVNVDTVFRACRAALAPMRRQGGGAILNIGSISGIVSNIPQNQVAYNTSKAAVHMMTKSLASEVAAENIRVNAIAPGYIETDLSRGGIDNPDWFPTWRSMTPMGRVGQPEEVASAALFLCSAAASYVTGEVLVIDGGYTTR

SEQ ID NO: 27190 - protein, 630 aa, Candida glabrata
MDYEVNANQIPVLGIEQGLIPDNLDGSVKADTATSTAMNMNDKSEISNDGSHSIHTSNPNNNGENGKNGGKPASNDFVRKLFNILESNQYSNIVRWSNTGDSFVVLDTGKFTTQILPNHFKHSNFASFVRQLNKYDFHKIKRTNEERQKSIYGEQSWEFENPNFKINDEKSLDLIKRKTPAQRKVMLEDASAPSQKTPELLSVQSENKLKSALLSNTVKKDIFNNLRKRVDKMQKDMDTVMMDNYNLKSDYQKLATKYNTLLDSLITFRTVNENLINNFNALCNVLSSKGVELPSSVYENMNINIPVPSGQSPVNISPSPSLGIPIKNSTMSPSLPSMKSLQNTPSLTGKLSTNQRLDLPPNSQGILSDTNVGQTESPEIQMPISSNSSSTTKEVDQNIVLRKGFHVLLVEDDSVSIQLCSKFLRKYGCTVQVVTDGLSAISNLEKFRYDLVLMDIVMPNLDGATATSIVRSFDNQTPIIAMTGNIEDQDLITYLQHGMNDILAKPFTRNDLHSILIRHLKDRIPLCDQNRGSGITSESPNLPPTQHIISSQQNNEQNSSLPQSLPPIHPPNHQSPLFNNRASNITPLAPLNSAMSPQSPSHLERPLTNRSPLGMTPLNDGQPAFKKQHT

SEQ ID NO: 27191 - protein, 135 aa, Hordeum vulgare
DLLIEFHQPVREEKKKEIEGKDVEMGFDITHTKHKGQYALRKLYHGSPRLILVLYTSPTCGPCRTLKPILNKVIDEYDEYVHFVEIDIEEDPEIAEAAGIMGTPCVQFFKNKEMIRTFSGVKMKKEYREFIESNK

SEQ ID NO: 27192 - protein, 509 aa, Geobacillus kaustophilus
MLLDADIKAQLAQYLQLLENDIVLTVSAGDDNVSRDMLALIDELTAMSSKIKVEKAKLERTPSFSVNRVGENTGITFAGVPLGHEFTSLVLALLQVSGRPPKVSQDVVDRIQQIRGKHHFETYVSLTCHNCPDVVQALNIMSVLNPDISHTMIDGAAFKEEAEQKGIMAVPTVFLNGKLFASGRMSLEDILAKLGSAPDASSFADKEPFDVLVIGGGPAGATAAIYAARKGIRTGIVAERFGGQILDTLGIENFISVKYTEGPKLAASIEEHVKQYNVDIMNSQRAKRLEKKDLIEVELENGAVLKSKTVVIATGARWRNLGVPGEEEFKNKGVAYCPHCDGPLFEGKHVAVIGGGNSGVEAAIDLAGIASHVTLLEFAPELKADAVLQDRLYSLPNVTVIKNAQTTEITGTDKVNGLTYIDRETGEEHHIELQGVFVQIGLVPNTEWLEGTVERNRFGEIIVDKRGATNIEGVFAAGDCTDSAYKQIIISMGSGATAALSAFDYLIRH

SEQ ID NO: 27193 - protein, 296 aa, Arabidopsis thaliana
MAEHLASIFGTEKDRVNCPFYFKIGACRHGDRCSRLHNRPTISPTLLLSNMYQRPDMITPGVDAQGQPLDPRKIQEHFEDFFEDLFEELGKFGEIESLNICDNLADHMIGNVYVQFKEEDQAAAALQALQGRFYSGRPIIADFSPVTDFREATCRQYEENNCYRGGYCNFMHVKLVSRELRRKLSGRYRRSYRRGSRSRSRSRSISPRNKRDNDRRDPSHREFSHRDRDREFYRHGSGKRSSERSERQERDGSRGRRQASPKRGGSPGGGREGSEERRARIEQWNREREEKEEGGA

SEQ ID NO: 27194 - protein, 828 aa, Unknown
  Photobacterium sp. SKA34
MKMTRRAFVKANAAASAAAVAGISLPASATNLIVSSDETKIKWDKAPCRFCGTGCSVLVGTQNGRVVATQGDPKAPVNKGLNCIKGYFLSKIMYGKDRLQTPMLRMKNGQYDKEGEFTSVSWDTAFDVMAEKWKLALKKQGPSGVGIFGSGQWTVMEGYAASKMMKAGFRSNNIDPNARHCMASAVVGFMRTFGIDEPMGCYDDLEHADVFVLWGSNMAEMHPILWTRMTDRRLSHPHVKVNVLSTYQHRSFELADNGMIFEPQTDLAIANFIANYIIQNDAVNWDFVNKHTHFKRAQNDIGYGLRDDNPLQQQAANPNSGDIFPMNFEEYKASVADYTVEKASEMSGVAPEKLIQLAKYYADPKLKVMSLWTMGMNQHTRGVWMQSLVYNLHLLTGKIATPGNSPFSLTGQPSACGTAREVGTFAHRLPADMVVANPKHREIAEKIWKLPEGTIPPKPGYHAVLQDRMLKDGKLNAYWVMCNNNMQAGPNINEERLPGYRNPENFIVCSDPYPTVTAQASDLILPTAMWVEKEGAYGNAERRTQAWYQQVEAPGEAKSDLWQIMEFSKRFKVEEVWGEELINKMPQYRGKTMYDILFRNGQVDKFPLSEAQELNDDAKAQGFYVQKGLFEEYASFGRGHGHDLAPYDTYHQVRGLRWPVVDGKETLWRFKEGSDPYAKKGTDWDFYGKPDGKAWIISAPYEAPPEVPDSEYDMWLCTGRVLEHWHTGTMTRRVPELYKAVPDALCYLHPDDAKKRGLRRGDEVNVASRRGEVRCRIETRGRNRPPEGLIFIPFFDARILVNKLILDATDPLSKQTDFKKCPVKISKV

SEQ ID NO: 27195 - protein, 327 aa, Pneumocystis jirovecii
MHSKVIIIGSGPAGHTAAIYLARAELKPVLYEGMLANGIAAGGQLTTTTDVENYPGFPDGIMGPLLMEKFREQSVKYGTCIITETVSKLDLSKRPFKYWCESDENTCHTADVVVMATGAYARRLHIPGEETYWQRGISACAVCDGAAPIFRGKCLSVVGGGDSAAEESLFLTRYATKVYLLVRRDKLRASAVMAKRLLNHPKIEVIWNTVVLRSLGDGHLLNRLEIKNVKTQVVSELHVSGLFYAIGHEPATALVRGQVECDDNGYIITKNGGPETNIKGFFAAGDVQDKKWRQAVTSAGSGCMAGLAAERLLAEEEEMKNIEKNKK

SEQ ID NO: 27196 - protein, 283 aa, Arabidopsis thaliana
MAEHLASIFGTEKDRVNCPFYFKIGACRHGDRCSRLHNRPTISPTLLLSNMYQRPDMITPGVDPQGQPLDPSKIQDHFEDFYEDIFEELNKFGEVESLNVCVNLADHMIGNVYVLFKEEDHAAAALQALQGRFYSGRPIIADFSPVTDFREATCRQYEENSCNRGGCCNFMHVKQISRELRRKLFGRYRRSYRRGSRSRSRSISPRRKREHSRERERGDVRDRDRHGNGKRSSDRSERYDRDGGGRRRHGSPKRSRSPRNVREGSEERRARIEQWNRERDEGV

SEQ ID NO: 27197 - protein, 720 aa, Saccharomyces cerevisiae
MTQQEYRSPSQRLSKGRSMSLPKIFARNLRSLQNNAPPGKNINVNCLNVNSCSLSASPSSQINMACNGNKQDLPIPFPLHVECNDSWSSSKLNKFKSMFNHNRSKSSGTTDASTSEKGTHKREPRSTIHTELLQSSIIGEPNVHSTTSSTLIPNEAICSTPNEISGSSSPDAELFTFDMPTDPSSFHTPSSPSYIAKDSRNLSNGSLNDINENEELQNFHRKISENGSASPLANLSLSNSPIDSPRKNSETRKDQIPMNITPRLRRAASEPFNTAKDGLMREDYIALKQPPSLGDIVEPRRSRRLRTKSFGNKFQDITVEPQSFEKIRLLGQGDVGKVYLMRERDTNQIFALKVLNKHEMIKRKKIKRVLTEQEILATSDHPFIVTLYHSFQTKDYLYLCMEYCMGGEFFRALQTRKSKCIAEEDAKFYASEVVAALEYLHLLGFIYRDLKPENILLHQSGHVMLSDFDLSIQATGSKKPTMKDSTYLDTKICSDGFRTNSFVGTEEYLAPEVIRGNGHTAAVDWWTLGILIYEMLFGCTPFKGDNSNETFSNILTKDVKFPHDKEVSKNCKDLIKKLLNKNEAKRLGSKSGAADIKRHPFFKKVQWSFLRNQDPPLIPALNDNGCELPFILSCNKHPKRNSVSEQETKMFCEKVANDDEIDEADPFHDFNSMSLTKKDHNILTYSENYTYGKILYKATCTRPRHNSSHRSFFKDIIPEL

SEQ ID NO: 27198 - protein, 643 aa, Geobacter metallireducens
MIHSRTILVPTLLFQLALALPLAAGADSRCDDAKRLAATIPVQADGDTTRKTEDVVLESCADGAAGYFVRGLRAERAGRHDEAIKDYREALRLEPAFPRAQGNLGLALLAKGSHDDAVVELTRAISSDPDPGYHHGLAMIFGQRKIYSLALYHYAEAAKGLPADPVIPTELAALYREMGKVSDAEKQYRKALSLSPSHEEARVGLASLYMAEGRTDRAIEELKQAQIASPGNKEVSSLLAEAYEKKGDRQAADYQSLLAGKQRGVLSDERLRRGDELMQAKEYAKAAEEFKAALREKPDWPEALMRLAEAQTAAGFDDEAITSYKELIRLKLGTGDTHYNLGVLYERKGLIDEAVVEYKQAIHSSPDNGDARRRLADIYALRGSYPQAIEQYRELLKKGDNNPVLHLKLARALLGAKNPKEAMASYQDALKIAPDNLEARRELAALYRKGNQNEEAEKQYKEILRIKKDDAEARNILTALYVKSKKYDELITLLKDGVELAPNDPASHYKLGLIYEFKKDYDAAEQEYKKAVELKGDHAKSLNALGRIYLKTGKISEAKGALEAAKKADPGMEETAVLLSNIKEELSPEPPRYSKKGRKGKASKEAKKSRASKKKSSKKGAKATSKKSSTKSGGKAKKAKKSH

SEQ ID NO: 27199 - protein, 349 aa, Pseudomonas aeruginosa
MPAEVAAGLPPLPPNHFYFYPPDPLLEGDGAITAIEDSDPFDQYVYRLRRVLYQGRTRWQNVLIADTYNYDRVLMLDGAIQSAESDESLYHELLVQPAMLAHDEPRDVLIIGGGEGATLREVLSHASVRRAVMVDLDRELVELCREHLFQWHQGAFDDPRCELLAEDGRAYLERDPSLYDVVIIDVVDMLDNGPAQALYTRQFYELLHSRLRPGGVVAVQGLEFSHSDDKPHAALARTLRSVFSQVHSYRATVPSFLSSWGFLLASDWLDTNHWQAEDIDRRIERKLGPLWLDHLDGDYLKACFVMDRETRFLLAQPGPVLEDGVPFVAPPDIEEIEFGPAQLPALART

SEQ ID NO: 27200 - protein, 474 aa, Thermus thermophilus
MSFPLIFERSRKGRRGLKLVKAVPKAEDLIPKEHLREVPPRLPEVDELTLVRHYTGLSRRQVGVDTTFYPLGSCTMKYNPKLHEEAARLFADLHPYQDPRTAQGALRLMWELGEYLKALTGMDAITLEPAAGAHGELTGILIIRAYHEDRGEGRTRRVVLVPDSAHGSNPATASMAGYQVREIPSGPEGEVDLEALKRELGPHVAALMLTNPNTLGLFERRILEISRLCKEAGVQLYYDGANLNAIMGWARPGDMGFDVVHLNLHKTFTVPHGGGGPGSGPVGVKAHLAPYLPVPLVERGEEGFYLDFDRPKSIGRVRSFYGNFLALVRAWAYIRTLGLEGLKKAAALAVLNARYLKELLKEKGYRVPYDGPSMHEFVAQPPEGFRALDLAKGLLELGFHPPTVYFPLIVKEALMVEPTETEAKETLEAFAEAMGALLKKPKEWLENAPYSTPVRRLDELRANKHPKLTYFDEG

SEQ ID NO: 27201 - protein, 126 aa, Brassica napus
MANLMMLRFPSSLRSFSVSASSSNGSPPVIGGSSGGVGPMILELPLEKIRRPLMRTRSNDQNKVKELMDSIRQIGLQVPIDVIEVDGAYYGFSGCHRYEAHQKLGLPTIRCKIRKGTKETLRHHLR

SEQ ID NO: 27202 - protein, 464 aa, Fusobacterium nucleatum
MMRSSTLKLRNKMLKVSDIIQIKIDKIVFGGEGLGYYNGFAVFVPMSIPEDELEIEIISIKKTYARGLIKNIIKASPERIDNHKFTFEDFYGCDFAMLKYESQLKYKRFMVEEVIRKIAGLSDIEISDVLASEDIYNYRNKIIEPFSVYANKIITGFFKRKSHEVFEVDENILNSKLGNKIIKELKEILNKNKISVYDENTHKGILRNIMIRTNSNNEAMVVLIINSNKITENIKKLLFKLRENIEEIKSIYISLNSKKTNTVIGEKNILIYGEKSIKENINRIEFHISPTSFFQINVKQAKRLYDIAISFFDNIDNKYIVDAYSGTGTIGMIIAKKAKKVYAIEIVKSASEDGEKTAKENGIENIEFINGAVEKELVKLVNNNQKIDTIIFDPPRKGLETSIIDKVAELNLKEVVYISCNPSTFARDVKLFSEKGYVLKKLQAVDMFPQTSHIECVGLIERKI

SEQ ID NO: 27203 - protein, 255 aa, Unknown
  Synechococcus sp. RS9917
MTQTDALVSIVGAGPGAPDLLTRRAEDRIRSADVLIWTDSLVSPEIAALAGPDCERIRSSTLTLEDVVPLMIDRVRQGLRVVRLHDGDPCLYGALTEQICGLADAGIDTEVVPGLSAYQATASALKAELTIPGLVQTIVLSRAGGRTGVPETETLEQLARLRASLCLYLSARHVEEVQATLLEHYPADTPVAIGYRVSWPDQWLQVVPLERMAQTSQERGLIRTTLYAISPALTAHGHRSKLYSPEHDHLFRPQR

SEQ ID NO: 27204 - protein, 258 aa, Calystegia sepium
MAGRWSLQGMTALVTGGTRGLGHAIVEELSSLGAIAYTCSRNQKELDECLKNWKEKGYPVFGSTCDISQQSERENLIQLVCKQFDGKLHILVNSAATIIPKETLNLNAEDNSIVIGTNLMTSLNFSQLAHPLLKASGNGSIVFISSCASFVFVPVHTVYAATKGAINSLAKNLACEWANDNIRVNAVAPWAMRTSLTEAAREEAGGEILEALIQRTPQHRLVEPKEASAAVAFLCFPASSFVTGQVICVDGGATSYGL

SEQ ID NO: 27205 - protein, 98 aa, Nostoc sp.
ATVYKVTLVDQEGTETTIDVPDDEYILDIAEDQGLDLPYSCRAGACSTCAGKIVSGTVDQSDQSFLDDDQIEKGYVLTCVAYPTSDLKIETHKEEDLY

SEQ ID NO: 27206 - protein, 98 aa, Nostoc sp.
ATYKVRLFNAAEGLDETIEVPDDEYILDAAEEAGLDLPFSCRSGSCSSCNGILKKGTVDQSDQNFLDDDQIAAGNVLTCVAYPTSNCEIETHREDAIA

SEQ ID NO: 27207 - protein, 395 aa, Triticum aestivum
  misc_feature (125)..(125): Xaa can be any naturally occurring amino acid
  misc_feature (134)..(134): Xaa can be any naturally occurring amino acid
  misc_feature (152)..(152): Xaa can be any naturally occurring amino acid
MAAPTSAIGFEGYEKRLEITFSEASIFADPHGRGLRALSRAQIDSVLDLARCTIVSELSNKDFDSYVLSESSLFIYSQKIVIKTCGTTMLLLTIPRILELAEELCMPLAAVKYSRGMFIFPGAQXPAPHRSFSXEEVDVLNRYFGHLKSGGXNAYVIGDPAKPGQKWHIYYATEQPEQPMVTLEMCMTGLDKKKASVFFKTQADSHVSCAKEMTKLSGISDIIPEMEVCDFDFEPCGYSMNAINGSAVSTIHVTPEDGFSYASYEVMGMDASALAYGDIVKRVLRCFGPSEFSAAVTIFGGRGHAATWGKKLDAEAYDCNNVVEQELPCGGVLIYQSFTVNEEVAVSAGSPRSVFHCFEAESVHSHPLVKEGKLANLLAWRAEEDSLEEGAVLCE

SEQ ID NO: 27208 - protein, 96 aa, Synechocystis sp.
ASYTVKLITPDGENSIECSDDTYILDAAEEAGLDLPYSCRAGACSTCAGKITAGSVDQSDQSFLDDDQIEAGYVLTCVAYPTSDCTIETHKEEDLY

SEQ ID NO: 27209 - protein, 260 aa, Pirellula sp.
MANEIVKEMIEAGVHFGHRTSLWNPKMAPYIFGKKNQIHILDIRETLRGLLRAKKYLSQVAAGGSLILFVGTKRQAGEAVEEQSLRCGMPFVSERWLGGTLTNFRTIRSRLGRLEELEALRAGDGINDYSKKMQSSLNREYRKMYRNLNGLRTMNRLPEVMFIVDPGKERNAVREAKRLGITTVALIDTDSDPSQIDLPIPGNDDGIRSVEMIMRELADAVIAGKGQTQTEAAPNAQAAPEAAAPAEQPAEEAAAASSEG

SEQ ID NO: 27210 - protein, 317 aa, Medicago truncatula
MEKVLRGNEVFGESCNWFKSVVALTLCFGAIHFNLALILFAIFFLSFSKALLLFGFLMLLMILPVDKNSLLGQKLSRFICKHVCSYFPITLHLEDAEAFHLNQPYVFCYEPHSVFPFGIFALHDNIDFMPIPNIRFLVSSAAFYIPYLRQIWTWLGFSYVTKKNLISLLVAGESCIIVPGGMRETLFMEHGCENVYLKERKGFVRIAMEMGHPLVPVFCFGQTNIYKWWKASGKLIQNLASSMKIFPLIFWGKFGSPVPFKNPLYVVVGKPIQVEKIPEPTSEQVAKVHSEFVEALQELFERHKTQAGCTNLELKIV

SEQ ID NO: 27211 - protein, 416 aa, Medicago truncatula
MIHRPPSNGRHCSPVISLFKLGNSETIPLDLFTPNIILSIYLNLLGSFVIERGKMEKVFVGSDKFAESSCNSFNTVLALLLWLGAIHFNGVVMVFALFFLPFSKALLVFGFLFVLMVIPIDEKSLFGRKLARYICKHACSYFPVTLHVEDIKAFHPNRAYVFGYEPHSVLPIGVVALADSTGFMPLPKIKVLASSAIFYTPFLRHIWTWLGLTPATKKNFTSLLDADYSCILVPGGVQETFFMEHGCEVGHIKRGEDFGGWDCNERPGSHIVTLMIAFLKARRGFVRIAMEKGKPLVPVFCFGQSDVYKWWKPGGKLILNIARAIKFIPIYFWGIFGSSMVWWLYQCSSLRGSDLQYHFKHPMHVVVGRPIELEKNPKPTPEEVAKVHSQFVEALQDLFECNKTRAGYPNLELRIV

SEQ ID NO: 27212 - protein, 515 aa, Brassica napus
MLDSLVSKLPSLSTSDHASVVALNLFVALLCACIVLGHLLEENRWMNESITALLIGLGTSVTILLISKGKSSHLLVFSEDLFFIYLLPPIIFNAGFQVKKKQFFRNFVTIMLFGAIGTVVSCTVITLGVTQFFKKLDIGTFDLGDYLAIGAIFAATDSVCTLQVLNQDETPLLYSLVFGEGVVNDATSVVVFNAIQSFDLTHLNHEAAFQLLGNFMYLFLLSTLLGVATGLISAYVIKKLYFGRHSTDREEVALMMLMAYLSYMLAELFALSGILTVFFCGIVMSHYTWHNVTESSGVTTKHTFATLSFLAEAFIFLYVGMDALDIEKWRFVSDSPGTSVAVSSILMGLVMLGRAAFVFPLSFLSNLSKKNQSEKIDIKQQVVIWWAGLMRGAVSMALAYNKFTRSGHTELRGNAIMITSTITVCLFSTMVFGMLTKPLIRHLMPHQSTTTSMLSDDNTPKSLHMPLLDGEQQDSFVEFSGSHHDVPRPDSLRGFLMRPARTVHHYWRQFDDSNH

SEQ ID NO: 27213 - protein, 493 aa, Unknown
  Shewanella sp. MR-4
MSDNQPQAAKHTLMWFRQDLRLTDNQALTAACDWVRQVPGAKLRAIYIATPSQWLSHDMAPIQIDFIQRHVNLLAQGLASLGIEFELIQLDSFKEVPAFLASYCEKLGVERVFAGREPEINEQKRDQACLDVGIPLVLSDEHCLLPPGTVLNLSGDMYKVFTPFSRKWREVAAKRAILPLAVPAPLGPMLPEPKPISFKERFPFTSKLTSSEQWAAGEGQAKRILTAFIQQKAQDYKQDRDFPALEGTSVISPYLALGVLSPRQCIAALLGRFPEVIVDDTSPGRTWLNELIWREFYRHLLVAFPDLSKGHNFNRQADHVQWRNNQAEFLAWCEGKTGYPIVDAAMRQLNQTGWMHNRLRMVVASFLTKHLLIDWRWGERYFRQHLIDGDLAANNGGWQWSAGCGCDAQPYFRIFNPISQSEKFDPDGSFIRKYLPELASWGIKRLHQPNMQKTPSLFEVPTLESDSAYPYAIVEHNAARARALAVLGVLKKA

SEQ ID NO: 27214 - protein, 243 aa, Oryza sativa
MVVGAGGGDELKLLGVWDSPYVNRVQIVLNLKGLSYEYVEEDLMNKSDLLLGSNPVHKKVPVLIHNGKPIAESRVIVEYLDEAFAAGAGGSTGASVLPSDPYERAVARFWAAYVDDKVGSPWYTILFVRERGEKVEAAARAISALETVEAGAFRDRSSEGKTTNAAAAPFFGGDSIGFVDVVLGSYLGWFRVIEKMIGVRIMDAARTPRLAAWAERFEAADAVRGVLPDDVDKVIDFLQAFLH

SEQ ID NO: 27215 - protein, 950 aa, Pseudomonas fluorescens
MTQVNLGTANEFIARHIGPRAGDEQAMLNSLGFDSLEALSASVIPESIKGTSVLGLDDGLSEADALAMIKGIAGKNQLFKTYIGQGYYNCHTPSPILRNLLENPAWYTAYTPYQPEISQGRLEALLNFQTLISDLTGLPIANASLLDEATAAAEAMTFCKRLSKNKGSHQFFASIHSHTQTLDVLRTRAEPLGIDVVVGDERELTDVTPFFGALLQYPASNGDVFDYRELTERFHAANALVAVAADLLALTLLTPPGEFGADVAIGSAQRFGVPLGFGGPHAAYFSTKDAFKRDMPGRLVGVSVDRFGKPALRLAMQTREQHIRREKATSNICTAQVLLANIASMYAVYHGPKGLTQIANRVHHLTAILAKGLSALGVTVEQTSFFDTLTLATGAQTAALHDKARAQQINLRVIDAQRLGLSVDETTTQADIETLWGLFADGKTLPDFAALAAAAQSTIPASLVRQSPILSHPVFNRYHSETELMRYLRKLADKDLALDRTMIPLGSCTMKLNAASEMIPVTWAEFGALHPFAPAEQSAGYQQLTDELEAMLCAATGYDSISLQPNAGSQGEYAGLLAIRAYHQSRGEDRRDICLIPSSAHGTNPATANMAGMRVVVTACDARGNVDIEDLRAKAIEHREHLAALMITYPSTHGVFEEGIREICGIIHDNGGQVYIDGANMNAMVGLCAPGKFGGDVSHLNLHKTFCIPHGGGGPGVGPIGVKSHLTPFLPGHGHMERKEGAVCAAPFGSASILPITWMYIRMMGGAGLKRASQLAILNANYISRRLEEHYPVLYTGSNGLVAHECILDLRPLKDSSGISVDDVAKRLIDFGFHAPTMSFPVAGTLMIEPTESESKEELDRFCDAMIRIREEIRAVENGTLDKDDNPLKNAPHTAAELVGEWTHPYSREQAVYPVASLIEGKYWPPVGRVDNVFGDRNLVCACPSIESYA

SEQ ID NO: 27216 - protein, 473 aa, Salmonella enterica
MPTHLVWFRRDLRLQDNLALAAACRDASARVLALYISTPAQWQAHDMAPRQAAFISAQLNALQTALAEKGIPLLFHEVADFNASIETVKNVCRQHDVSHLFYNYQYEFNERQRDAAVEKTLPSVICEGFDDSVILAPGAVMTGNHEMYKVFTPFKNAWLKRLKEDIPPCVPAPKIRVSGALSIPLTPVSLNYPQQAFDAALFPVEENAVIAQLRHFCSQGADEYASRRDFPAVDGTSRLSASLATGGLSPRQCLHRLLAEQPQALDGGPGSVWLNELIWREFYRHLMTWYPALCKHQPFIRWTKRVAWQENPHYFQAWQKGETGYPIVDAAMRQLNATGWMHNRLRMITASFLVKDLLIDWRLGERYFMSQLIDGDLAANNGGWQWAASTGTDAAPYFRIFNPTTQRERFDRDGEFIRQWLPALRDIPGKAIHEPWRWAEKAGVVLDYPRPIVEHKQARIATLSAYEAARKGA

SEQ ID NO: 27217 - protein, 1106 aa, Pseudomonas putida
MAKRARTAAFIDDPLWYKDAVIYQLHIKSFFDSNNDGIGDFAGLISKLDYIAELGVNTLWLLPFYPSPRRDDGYDIADYKAVHPDYGSLGDARRFIAEAHKRGLRVITELVINHTSDQHPWFQRARHAKRGSKARDFYVWSDDDQKYDGTRIIFLDTEKSNWTWDPVAGQYFWHRFYAHQPDLNFDNPQVLKAVIGVMRFWLDLGVDGLRLDAIPYLIERDGTNNENLAETHDVLKAIRAEIDANYPDRMLLAEANQWPEDTRPYFGEGEGDECHMAFHFPLMPRMYMALAMEDRFPITDILRQTPEIPANCQWAIFLRNHDELTLEMVTDRERDYLWNYYAEDRRARINLGIRRRLAPLLQRDRRRIELLTSLLLSMPGTPTLYYGDELGMGDNIYLGDRDGVRTPMQWSPDRNGGFSRADPQRLVLPPIMDPLYGYQTVNVEAQSHDPHSLLNWTRRMLAVRKQQKAFGRGSLRTLTPSNRRILAYVREYTDVDGNTEVILCVANVSRAAQAAELELSHFADKVPVEMLGGSAFPPIGQLPFLLTLPPYAFYWFLLASRDRMPSWHIQPTEGLPELTTLVLRKRMEELLEAPSSDTLQATILPQYLPKRRWFAGKEGPIDAVRLCYGVRFGTATTPVLLSEIEVRSDGTATRYQLPFGLLREEQITTALPQQLALSRVRRAHQVGLITDAFVLEPFIRAVMLACQDGLRLPCGNDEGELRFECTAQLAGLALDEESEVRYLSAEQSNSSVVIGDRVVLKLIRRVNPGVHPELEMSAYLTAAGFANISPLLAWVSRVDEQQAPHLLMIAQGYLNNQGDAWGWTQNTLERAIRDQMEPTTSDPEAHTDALAELSGFAALLGQRLGEMHLLLAAPTEDPAFQPRPSNAQDSQRWSTQISAELTHALDLLAQHRDTLDRDSQALVDDLQQQRDGLAQHIDNLTDQAQGGLLMRVHGDLHLGQVLVVQGDAYLIDFEGEPARSLEERRAKHSPYKDVSGVLRSFDYAAAMILRSASAVDLSDPARQARQRVARQYLHQSRHAFVEAYGLATAAMPHAWQRAEGERAALELFCLEKAAYEITYEAENRPSWLAVPLHGLHGLISTWGESE

SEQ ID NO: 27218 - protein, 206 aa, Clostridium perfringens
MISGIYERIQSLESLDLKSLDKNRTILLIVDINKGFAKAGALYSDRIEKLINPISNLAKYALNNGIKVKAFTDYHTEDSIELKAYPKHCMKDTDEWELVEELNLEGIEVIKKNSTNGFLEENFILNKEEIDNVIIVGDCTDICIYQLAISLRAEFNRVNKDGEIYVPKKLVDTFDMPMHKANFMNYVFLNSMIDNGVNVIEDIILD

SEQ ID NO: 27219 - protein, 717 aa, Pseudomonas putida
MSPRTPKKTRSVAPSRIREGMPFPLGATWDGLGVNFALFSANATKVELCLFDSTGEQEIERIELPEYTDEIYHGYLPDAHPGLVYGYRVYGPYEPENGHRFNPNKLLIDPYAKQLVGSLKWSEALFGYTIGHPDGDLSFDERDSAPFVPKCKVIDPAFTWGRDQRVLIPWERTIIYEAHTRGISMRHPAVPEALRGTFAGLANDELLKHIKDLGVSSIELLPIHAFVNDQHLLDKGLNNYWGYNSIAFFAPHPRYLASGKIAEFKEMVAHLHDAGLEVILDVVYNHTAEGNERGPTLSMRGIDNASYYRLMPDDKRYYINDSGTGNTLDLSHPCVLQLVTDSLRYWAGEMHVDGFRFDLATILGRYHDGYSERHGFLVACRQDPMLSQVKLIAEPWDCGPGGYQVGNFAPGWAEWNDRFRDTARAFWKGDEGQLADFAARLTASGDMFNNRGRRPYSSVNFITAHDGFTLRDLVSYNHKHNEDNDENNQDGTDNNLSWNCGVEGPTDDPGINALRMRQMRNYFATLLLAQGTPMIVAGDEFSRTQHGNNNAYCQDSEIGWVNWDLDQQGEELLAFVKRLTRLRLAYPVLRRSRFLVGDYNEAIGVKDVTWLAPDGSEMTVEQWEDPHGRCLGMLIDGRAQVSGIARPGAEATVLLIVNAHHDIVPFKLPSVPEGEYWSCLVDTDRPELRKGQHLQFDSTFEVKGRSMLLMVLQRDEE

SEQ ID NO: 27220 - protein, 191 aa, Triticum aestivum
  misc_feature (82)..(82): Xaa can be any naturally occurring amino acid
  misc_feature (112)..(112): Xaa can be any naturally occurring amino acid
MAARRGAVVAALMVVAAALVGLAGADFAADRAECADKLMGLATCLTYVQLAATARSPTPDCCSGFRQVLAASKRCLCVLVKXRDEPPLGIKVNVTRAMNLPSACNIAATFSXDCPKILNMSPDSKETEIFKQYAREHEGKNAATTSPTAAAATATGTATGKSVDATSGAGRHTVVFAVVVSALLASAFVLA

SEQ ID NO: 27221 - protein, 193 aa, Solanum demissum
MTTFTNPTTLFHPKIKITKTHHTQCKTLPKIQSNLSTNEENFTCRRKLIATFLATPLTLGLPFTPLALAENWGVRSFLREHFFEPGLSPEDAVARIRQTADGLHSIKEMLETNSWRYVLFYIRLKSAYLKQDMKNALSRVPESRKESYIKTANELTDNMAEFDYYIRTPKVYESRVFYEKTLKSIDELVGLLA

SEQ ID NO: 27222 - protein, 559 aa, Candida albicans
MSSLQQPIPPNSTLATTASSNQSGSNDFVKKLFLMLQEDSYKEVVRWTAKGDSFVVINTNEFTKDILPKHFKHSNFASFVRQLNKYDFHKVKISNKAKASYPYGEDAWEFKHPEFRINDAEALENIKRKGPTAKKSASNVTIKTEANNNGTQPTCNHNYSQLVSATNHLKEQVESLKKDKHSLYQEISVLERKYKTVVENIVAINTFNERYYRSMNVLINSIVQNGMKLPPLDFPPPVQLGPDSGIGSNLGPISSDTALPSISHHLSSPLPHHQQLLNRTIRPISSPIDGIPLVKLQQQSLGQNLQAPIGTPSAVPFSEEASSSIQAATPAPLAQPVAQPINQPPPPPPPPATQQQPLPPPPPPATATSQIPSAPPPPTQQQVGTSSSSVPTISPKSQGIVVSNSASPTTSAQISTTSVPNPKFHVLLVEDDNVCIQLCRKFLVKYGCSVTVVTDGLNAISTVEHTKYDLVLMDIVMPNLDGATATSVIRSFDTKTPIIAMTGNIEDNDLVTYLQNGMSDILAKPFTKDDLYAILSKHLLDPKENKQDNEPTVKKQKLS

SEQ ID NO: 27223 - protein, 117 aa, Brassica napus
MSYNNNGNVVPAADPLPGKKTKLQSSRSWVSIVATGESETLDVDKYAIMHRVQIHARDLRILDPNLSYPSTILGRERAVVLNLEHIKAIITADEVLLRDPSDENVIPVLKELERRLP

SEQ ID NO: 27224 - protein, 312 aa, Myxococcus xanthus
MAAAGGITMRQLLEAGVHFGHQTKRWNPKMKPFIFGARNGIYIIDLQKTVVMARSAFRFVADITARGGSVLFVGTKKQAQDVVREEASRAGQFFVTSRWLGGTLTNFKTIKQGIDRLKTLEKMAEDGTFERLPKKEVAQLEREREKLEKNLGGVKEMSKLPRCVFVIDPKKEHIAIHEAGRLGIPVIGLVDTNCDPDGIDFVIPGNDDAIRSIKLFTSKIAEACLEGAARYRASGAAERDEQEEREGRDDRGDRRDDRRGPRRGDRRDDRRDRGGDRGGDRRGPLVEMKGAAPVASAEPAAEAAPEGEAAAE

SEQ ID NO: 27225 - protein, 184 aa, Brassica napus
MAVQPTRIGLAGLAVMGQNLALNIASKGFPISVYNRTTSKVDETVERAKKEGNLPVYGFHDPESFVNSIQKPRVIIMLVKAGAPVDQTIKTLSAYLEKGDCIVDGGNEWYENTERREKAVAENGFLYLGMGVSGGEEGARNGPSMMPGGSFEAYKNIEDILLKVAAQVRDRGPCVTYIGKGGSG

SEQ ID NO: 27226 - protein, 611 aa, Geobacter sulfurreducens
MCGIVGKYYFNKNAGDSSDIDAMMQAIYHRGPDSSGKYINGRAALGFQRLSIIDTVSGHQPLYNETKTIVLLANGEIYNYKEFVPFLESKGHVFSTRSDCEVIIHLYEEYGIEFISKLNGMFAFCLYDTRNDVMFIARDRVGIKPLYYHLNKEAIIFGSEIKGILASGEVVTEEANDCLAEYLCFRYVANFRTFFSSVNALEPGTYIKISPNGCTFEKFWDLSKYVLNYAQDGDLVETVDAALTASVQRQMMTDVPLGTQLSGGVDSSLVSKLAAGYSPGLKTFTVSFFESAYDESAYARLLADSAGLEYHQIRVDGKTFADTLPKVIWYHDEPLCHANSVHMYLLCTYARQFVTVLLTGEGADELFAGYPRYQICRFGDAYNKLNPSVASLVKSVLKGVPARKIVKIVDNLGLGARELALWNSSFTTKEKVSWLLDSGDVTLDARSALVDSVWNDELSLFDNLLLYEQKSYLQPILMRQDKMSMAASVESRVPVLDNEMLDVANTIPYQYKVRHFTPKHVFKKVAERHISRKIVYKKKVGFGVPVDEWLRDHSGLGRYLDLLLDTARGINGVSRPRIEQLIAEHASRRYNHGDVLWPLVNYAIWREQFFK

SEQ ID NO: 27227 - protein, 176 aa, Vibrio harveyi
MKHTVEVMISEQEVQERIRELGKQITERYQGSEDLVMVGLLRGSFVFMADLARAIELTHQVDFMTASSYGNTMESSRDVRILKDLDDDIKGKDVLIVEDIIDTGNTLNKIREILSLREPKSIAICTLLDKPSRREVEVPVDYVGFAIPDEFVVGVGIDYAQKYRDLPFIGKVVPQE

SEQ ID NO: 27228 - protein, 328 aa, Caulobacter crescentus
MDDASSLYDAARFKRAGRGKIYDSIIDTIGDTPLVRLPRLSAELNPKAEVLAKLEFFNPIASVKDRIGVSMIESLEAQGVLKPGATIIEPTSGNTGIALAFVAAAKGYKLTLVMPESMSIERRKMLLLLGAKLELTPAEKGMRGAVTRAQELIEATPGAVMPQQFENSANPLIHRVSTAEEIWNDTAGAVDAVVSGVGTGGTITGVGQALKARKPSLKMVAVEPEASPVLSGGAPGPHKIQGIGAGFVPGVLDRGVIDDIVQVSNDDAFAMARRAAATEGLPVGISSGAALTAAFDLALRDAYKGKTIVVIIPSFAERYLSTALFDGL

SEQ ID NO: 27229 - protein, 320 aa, Vibrio vulnificus
MIKKIGVLTSGGDAPGMNAAIRGVVRTALGAGLEVYGIYDGYLGLYEGRIKQLDRSSVSDVINRGGTFLGSARFPEFKEVAVREKAIENLKAHGIDALVVIGGDGSYMGAKKLTEMGYPCIGLPGTIDNDIAGTDYTIGYLTALNTVIESIDRLRDTSSSHQRISIVEIMGRHCGDLTLMSAIAGGCEYIITPETGLDKEKLIGNIQDGISKGKKHAIIALTELMMDANELAKEIEAGTGRETRATVLGHIQRGGRPTAFDRVLASRMGNYAVHLLMEGHGGRCVGIVKEQLVHHDIIDAIENMKRPVRNDLFKVAEELF

SEQ ID NO: 27230 - protein, 221 aa, Geobacter metallireducens
MKKDILEKGAIVQRDRETYAIAPHIPGGITDTATLRKICDVADRYGVKELKLTSAQRIALMGVKEEDLDTIWSDLDQQPGAAIGLCVRSVKICPGTTWCKRGVQDSVALGLKIDTIYHAMKLPNKMKMGISGCMVNCAETLLKDIGVVGTPKGWRIYVGGNAGARPRIGEVFTDTAPDDDEVLAVVARIVDYYKGSGSEQRLGRIVEQMGIETFRQAVLGT

SEQ ID NO: 27231 - protein, 346 aa, Bacillus licheniformis
MTKVSILGAGSWGTALALVLADNQYDVCIWGHREELIQQINEHHENKDYLPGVKLSENVRATTDLEAAVADVKTIIVAVPTKAIREVLAQAVSFINQKAIFVHVSKGIEPDTLLRISEMMKEEIPAELREDIVVLSGPSHAEEVGLRHPTTVTVSADSSIESAQAIQDMFMNQNFRVYTNPDMIGVEIGGALKNVIALAAGITDGLGYGDNAKAALITRGLAEIARLGTKMGGNPLTFSGLTGIGDLIVTCTSVHSRNWRAGNMLGKGFKLDEVLEEMGMVVEGVRTTKAAYQLSKKFDVKMPITEALHKVLFDGEKVETAVESLMARVKTHEMEDLVNTFENQMK

SEQ ID NO: 27232 - protein, 196 aa, Moorella thermoacetica
MSREALIERQTTETNIRLKVALDGSGTWQGSSGIPFFDHLLAQMARHGLLDLKVWAEGDLEVDNHHTVEDIGICLGQAVKKALGDKKGISRYGSALVPMDEALVLVALDFSGRPYLAWGLELPPGRIGSLETELVEEFLRAMVNNSGLTLHVRQLAGHNAHHLAEALFKALGRAIRQAVTLDPREQGIPSTKGILS

SEQ ID NO: 27233 - protein, 389 aa, Unknown
  Photobacterium sp. SKA34
MTDAIRKFLKLESAGGIVLIIAALIAMIIANSPLASVYTDTLHSYVAGLSVSHWINDGLMAVFFLLIGLEVKRELIEGALNTKEKAIFPAIAAVGGMVAPALIYVAFNYNDPMAIKGWAIPAATDIAFALGVMALLGNRVPVSLKVFLLALAIIDDLGVIVIIALFYSSDLSTISLAVASVATVTLFIMNAKNVTKLSWYLIVGAVLWISVLQSGVHATLAGVILGFTIPLTGKDGRSDKHSPLKHLEHALHPYVAFLILPTFAFANAGISLDGVSLESLSSMLPVGIAAGLFIGKPLGIFVACIIAVKCGFAKLPDDINFKHVFAVSVLCGIGFTMSIFISSLAFIGADESFATYSRLGILLGSTVAAVVGYVLLSRSLPKEAQKVEA

SEQ ID NO: 27234 - protein, 356 aa, Glycine max
MSLLSDLINLNLSESTEKIVAEYIWVGGSGMDLRSKARTLPGPVSDPAKLPKWNYDGSSTDQAPGDDSEVILYPQAIFKDPFRRGNNILVICDVYTPAGEPLPTNKRYDAAKIFSHPDVAAEEPWYGIEQEYTLLQKDVNWPLGWPLGGFPGPQGPYYCGTGADKAYGRDIVDAHYKACIYAGINISGINGEVMPGQWEFQVGPSVGISAGDEVWAARYILERITEMAGVIVSFDPKPIPGDWNGAGAHSNYSTKSMRDEGGYEVIKKAIEKLGLRHKEHIAAYGEGNERRLTGRHETADINTFSWGVANRGSSIRVGRDTEKNGKGYFEDRRPASNMDPYVVTSMIAETTILWKP

SEQ ID NO: 27235 - protein, 177 aa, Fagus sylvatica
NFPWKETLSFRSSAQPDSSNIVQDYLCNTMGEDFKPFGKVYQDYCDAMSTLSLGIMELLGMSLGVSQGHYREFFEENESIMRLNYYPPCQKPDLTLGTGPHCDPTSLTILHQDQVGGLQVFVDEEWRSITPNFNAFVVNIGDTFMALSNGRYKSCLHRAMVNSKTPRKSLAFFFCPK

SEQ ID NO: 27236 - protein, 215 aa, Saccharophagus degradans
MSLFYAKPEKAKMPTEKTALKGRNVPIETAAEHFVSGMPLAPPYPSNMQQCVFGLGCFWGAERKFWQLPGVYVTAVGYSAGFTPNPTYEEVCSGSTGHNEVVLVVYNPSQVSFKKLLAVFWESHNPTQGMRQGNDLGTQYRSGVYVYSDEQAEQAEHSKQVVQAMLTEKGYGEITTEIIKAKEFYFAEAYHQQYLAKNPNGYCGLGGTGIVVPCD

SEQ ID NO: 27237 - protein, 264 aa, Helicobacter pylori
MVTMKDLLECGVHFGHQTRRWNPKTKKFIFGVRKNIHIIDLQKTLRYFRYTYNIVRDASAQGKSIMFVGTKKQANETLKEFAESIQVPYVNYRWLGGMLTNFSTIRKSVRKLEIIEEMENSGQIDLLTKKEKLMILRKKEKLDKYLGGVRHMKKIPDMIFVIDVAKEKIAVAEARKLHIPIVAPLDTNCDPDLVDYPIPGNDDAIRSIRLFCKEMSEAILEGRELMQEEIVHADENSEEIEFVSNEEKEEMLAEIQKEITQGAE

SEQ ID NO: 27238 - protein, 379 aa, Fagus sylvatica
MAIDCITNITSMPHPPKEEHKDHQKQLVFDASVLRHQTNIPQQFIWPDEEKPRANAPELQVPLIDLRGFLSGDPTAANEASSLVGKACQKHGFFLVVNHGVDDKLIAHAHQYIDYFFELPMSAKQRAQRKVGEHCGYASSFTGRFSFKLPWKETLSFRSSAQPDSSNIVQDYLCNTMGEDFKPFGKVYQDYCDAMSTLSLGIMELLGMSLGVSQGHYREFFEENESIMRLNYYPPCQKPDLTLGTGPHCDPTSLTILHQDQVGGLQVFVDEEWRSITPNFNAFVVNIGDTFMALSNGRYKSCLHRAVVNSKTPRKSLAFFLCPKNDKVVSPPSELVDSLCPRVYPDFTWPMLLEFTQKHYRADVKTLEVFSNWLQQKNS

SEQ ID NO: 27239 - protein, 382 aa, Bacillus licheniformis
MTEEMNQIDVQVPEVGDVVKGIVTKVEDKHVDVDIPNCKQTGIIPISELSSLHVEKASDVVNVDDELELKVTKVEDDALILSKRAVDADRAWEDLEKKFESKEVFEAEVKDVVKGGLVVDIGVRGFIPASLVEAHFVEDFTDYKGKTLTLIVVELDRDKNRVILSHRAVVEKEQSERKQEFLQTLEAGQVLEGKVQRLTDFGAFVDIGGIDGLVHISQLSHSHVEKPSDVVEEGQDVKVKVLSVDRDNERISLSIKETLPGPWSNIGEKVKPGDVLDGKVQRLVSFGAFVEVLPGVEGLVHISQISNKHIGTPHEVLEEGQDVKVKVLDVNEEEERISLSMKELEENTDKAEQEDYRQYQAKEESSGFQLGEMIGDKLNKLK

SEQ ID NO: 27240 - protein, 438 aa, Helicobacter pylori
MNLKKTENALSLTLKNFIKSESFGGIFLFLNAVLAMVVANSFLKESYFALWHTPFGFQVGDFFIGFSLHNWIDDVLMALFFLMIGLEIKRELLFGELSSFKKASFPVIAAIGGMIAPGLIYFFLNANTPSQHGFGIPMATDIAFALGVIMLLGKRVPTALKVFLITLAVADDLGAIVVIALFYTTNLKFAWLLGALGVVLVLAILNRLNIRSLIPYLLLGVLLWFCVHQSGIHATIAAVVLAFMIPVKIPKDSKNVELLELGKRYAETSSGVLLTKEQQEILHSIEEKASALQSPLERLEHFLAPISGYFIMPLFAFANAGVSVDSSINLEVDKVLLGVILGLCLGKPLGIFLITFISEKLKITARPKGIGWWHILGAGLLAGIGFTMSMFISNLAFTSEHKDAMEVAKIAILLGSLISGIIGALYLFALDKRAALKK

SEQ ID NO: 27241 - protein, 402 aa, Fagus sylvatica
MEACDCIEPQWPADELLMKYQYISDFFIALAYFSIPLELIYFVKKSAVFPYRWVLVQFGAFIVLCGATHLINLWTFTMHSRTVAIVMTTAKVLTAVVSCATALMLVHIIPDLLSVKTRELFLKNKAAELDREMGLIRTQEETGRHVRMLTHEIRSTLDRHTILKTTLVELGRTLALEKCALWMPTRTGLELQLFYTLRQQNPIGYTVPIHLPVINQVFSNNRAVKIAPNCPVARIRPLAGKYVPGEVVAVRVPLLHLSNFQINDWPELSTKRYALMVLMLPSDSARQWHVHELELVEVVADQVAVALSHAAILEESMRARDLLIEQNVALDLARREAETAIRARNDFLAVMNHEMRTPMHAIIALSSLLQETELTPEQRLMVETILKSSNLLATLINDVLDL

SEQ ID NO: 27242 - protein, 64 aa, Crocus sativus
MGCFQSKSRRPFPGHEDPVLLASQTAFSVSEVEALFELYKSISSSVIDDGLINKEEFQLALFKN

SEQ ID NO: 27243 - protein, 414 aa, Staphylococcus epidermidis
MTENNNLVTSTQGIIKEALHKLGFDDGMYDLIKEPIRFLQVRIPVRMDDGTVKTFTGYRAQHNDAVGPTKGGVRFHPEVDEEEVKALSMWMTLKCGIVNLPYGGGKGGIVCDPRQMSIHEVERLSRGYVRAISQFVGPNKDIPAPDVFTNSQIMAWMMDEYSALDKFNSPGFITGKPIVLGGSQGRDRSTALGVVIAIEQAAKRRGMDIKDAKIVIQGFGNAGSFLAKFLYDLGAKVVGISDAYGALHDPNGLDIDYLLDRRDSFGTVTNLFEDTISNKELFELDCDILVPAAISNQITEDNAHDIKASIVVEAANGPTTPEATRILTERDILLVPDVLASAGGVTVSYFEWVQNNQGYYWTEEEVNDKLREKLVTAFDTIYELSQNRKIDMRLAAYIVGIKRTAEAARYRGWA

SEQ ID NO: 27244 - protein, 717 aa, Azospirillum brasilense
EFTPISWDQAFDIMATKWKETLKKKGPTAVGMFGSGQWTIMEGYAASKFMKAGLRSNNLDPNARHCMASAVVGFMRTFGMDEPMGCYDDMEQADAFVLWGSNMAEMHPILWTRVTDRRLTHEGCKVAVLSTYEHRSFDLADIGLVFTPQSDLAILNYIANHIIKTGRVNQEFIAKHVNFKRGRDDIGYRLRPEHPLEQKAKNVAKANESDPISFEEFAKFVEPYTLEKAHELSGVPKNRLEALAELYADPKVKVMSFWTMGFNQHTRGVWANNLVYNIHLLTGKISQPGCGPFSLTGQPVRCGTAREVGTFSHRLPADMVVTNPEHRKHAEEIWKLPEGTIPDKVGYHAVQQDRMLKDGKLNAYWVQCNNNMQTAPNTANETYLGYRNPENFIVVSDAYPTVTALAADLILPTAMWVEKEGGYGNAERRTQVWHQLVGAPGEARSDLWQIIEFSKRFAIEEVWPEELIAKKPEVRGKTLYDVLYCNGQVNAFPLSDCDPAYENRESQAFGFYVHKGLFEEYATFGRGHGHDLAPYDMYHQERGLRWPVVNGKETKWRYREGFDPYVPAGEGVRFYGNKDGKANIFALPYEPAAESPDKDYPFWLCTGRVVEHWHSGSMTLRVPELRKAFPSAVVFIHPDDAKDLNLRRGQEVRIASRRGEVRVRVETRGRNKPPRGLVFVPFFDHTVLINKVTLDATDPLSKQTDFKKCAVKIIPVA

SEQ ID NO: 27245 - protein, 507 aa, Bacillus halodurans
MSLVEIFRFRNERIKILHLTWIAFFISFFTWFNMAPLATTMMESMDWLTREHIAALAIINVALTIPARLIIGMLLDRFGPRIVYSSLLVLMAIPAFMFAFGDTWTQLMISRLLLSSIGASFVVGIRMVAEWFPPKDVGFAEGIYGGWGNFGSAVAAMVLPWFAITMFGGPEGWRYAMAFTGVVCLIYGVIYYLFVRDTPEGKTFVRAKRTGAMEVSSWKDLIWLIVWTIPLHAALGVLAWRLEGMGFLSETILYTIYLVLAVALVYQVYTILKVNVPLLKKGIPEDDRYSFKNVAALNSTYFANFGAELAIISMLPMFFQLTFSLTPAQAGLIASSFAFINLFARPLGGILSDRMGSRRNIMLVYMAGITIGLVGMGFMDSNWPLVVAILITVFTSVFIQGAEGATFAVIPMIKKRMTGQVAGMAGAYGNVGATIYLTLYTFVTPQQFFFILAGGALASFVICYFWLEEPENSFASEYALSSVDEQVVQEAEVSEAEESVVVQKKVL

SEQ ID NO: 27246 - protein, 443 aa, Staphylococcus epidermidis
MTHIQLDYGKTLEFFDKHELDQQKDIVKTIHQTIHKGTGAGNDFLGWLDLPVDYDKEEFSRIVEASKRIKSNSDVLVVIGIGGSYLGARAAIEMLTSSFRTNTEYPEIVFVGNHLSSSYTKELLDYLQGKDFSVNVISKSGTTTEPAVAFRLFKQLVEEKYGKDEAKKRIFATTDKSKGALKQLADNEGYETFVVPDDVGGRYSVLTAVGLLPIATAGINIESIMIGAAKAREELSSDDLDQNIAYQYATIRNILYSKGYTTEMLINYEPSMQYFNEWWKQLYGESEGKDFKGIYPSSANYTTDLHSLGQYVQEGRRFLFETVVKVNHPKHDIKIEEDADDLDGLNYLAGKSIDEVNTKAFEGTLLAHTDGGVPNIVVNIPQLDEETFGYVVYFFELACAMSGYQLGVNPFNQPGVEAYKQNMFALLGKPGFEDKKKELENRL

SEQ ID NO: 27247 - protein, 579 aa, Zea mays
  misc_feature (35)..(35): Xaa can be any naturally occurring amino acid
  misc_feature (161)..(161): Xaa can be any naturally occurring amino acid
  misc_feature (176)..(176): Xaa can be any naturally occurring amino acid
MASHIILPPDDADENHNHQTAAAAAAEEEEEGPHXSPPPPDDDEHGVPPALPPKAALPFSATCVRISRDSYPNLRALRNASSVSLADAAYVKISEADFGYVLDDVPHFTDYLPDIPTYPNPLQDHPAYSTVKQYFVNEDDTVPQKVVVQKNSRRGVHFRRXAGPRQRVYFGTDEVXKACIVTCGGLCPGLNTVIRELVCGLSHMYNVSSIFGIQNGYKGFYSSNYLPLTPKSVNDIHKRGGTVLGTSRGGHDTKKIVDNIQDRGINQVYIIGGDGTQKGAYEIFKEIRKRGLKVSVAGVPKTIDNDIAIIDKSFGFDTAVEEAQRAIDSAHVEACSAENGIGLVKLMGRYSGFIAMYATLASRDVDCCLIPESPFYLDGEGGLLQYVEKRLKENKHMVIVVAEGAGQDLIAKSLATSDQQDASGNKLLLDIGLWLTHKIKDYFKSKKMEMTIKYIDPTYMVRAIPSNASDNVYCTLLAHSAIHGAMAGYSFTVGMVNGRHTYIPFYRVTSTRNKVKVTDRMWARLLSSTNQPSFLSQKDIDEASEADRLANRPPLPTGASSRVARSFDQSSSCSSNGEI

SEQ ID NO: 27248 - protein, 807 aa, Bacillus halodurans
MKEKLVVVGNGMAGIRTVEELFERGGHERYEVTVVGEEPHVNYNRILLSSVLASEANMEDIELNSLDWYRENDVTLYRSEKVTKLDRKKKVVLTDKGQKIAYDKVILATGSHPFMLPLPGSDLEGVIAFRNIEDCETMIETAKNYKKAVVIGGGLLGIEAARGLLNLGMEVEVVHIFDYLMERQLDRTAANILRTELENQGMKFLLEKHTEAIIGKGRVERVKFKDGTETRADLVVMAVGIRPNHEVASASGIEVNRGIVVDDYMQTSDPDVYAVGECAEHRGMVYGLVAPLWEQGKILANALMDNKDEKYEGSVLYSKLKVSGVQVFSVGEFQEQDDAKSVSMLDEFAGIYKKIVTRGDKIVGSILVGDTSESTILLNQIIKGVPFEGSPMQLLRSHVGSADDGVSAVSMLSNEDQVCGCNGVSKGAIIDAIKTQGCASVADVGACTTAGRSCGTCKPMIADLLAEELGETANEKETMCGCTDLSHEEVVAAIREKGLTHTREVMNVLGWKEEHGCSKCRPAINYYLAMVHPLEHEDERESRFVNERLHANIQKDGTYSVVPRMYGGVTNPDELRRIADVAEKFNVPLLKITGGQRIDLLGVKKEDVPSVWKELDMPSGYAYGKALRTVKTCVGEDFCRFGTQDSIGLGIAIEKKFERLNTPHKVKMAVSACPRNCAESGIKDVGIVGVEGAWEIYVGGNGGASLRLGDLMCRVKTSEEVLEIIGAFLQLYREEARYLERTSHWVERVGLDYIKETLLEHPENRKVLNERMDEALSVLTDPWEEINNDPSLKETLFEEKVAVVTSE

SEQ ID NO: 27249 - protein, 262 aa, Unknown
  Sulfitobacter sp. EE-36
MAKTPTGKTPTGGASGGKTPTGKNTSGRGQRDLKVKVKSARGRKLSSTRWLQRQLNDPYVKRANAEGYRGRAAYKIMELDDKYRFLVPGARVVDLGAAPGGWCQVAVKRCNVLGEKKGKNVGTILGIDLQEMEPIAGCELHQLDFMEDDADEIVKGWLGGKADVVMSDMAASSSGHKQTDHNRIIALCEAAAYFAFDVLEDGGTFVAKVLAGGAEGDLQQLLKRRFTKVANIKPPASRSDSSEKFVVATGFKGALPEDQENL

SEQ ID NO: 27250 - protein, 260 aa, Triticum aestivum
PEQRLMVETVLKSSNLLATLINDVLDLSKLEDRSLELEIRAFNLHAVFKEVMGFIRPIAAIKRLSMSVMLTPDLPLCAIGDEKRLMQTILNISGNAVKFTKEGHITLLASVLKPDSLREFRTPDFHPAASDDHFYLKVQLKDTGCGISPQDLPHVFTKFAQTQPGGNQGYSGSGLGLAICRRFVTLMGGHIWLDSEGAGRGCTATFIIRLGVSDNTDAYQQQLAPLAWPGSANVESAGPKALHEETWPPSSLKPRYQRSV

SEQ ID NO: 27251 - protein, 743 aa, Bacillus halodurans
MEEMIQFFREKQKQQGKEARYDTRCPFCSVQCSMTLTEEKLVATSRFKAIPNKQDPTSEGRLCIKGVHAHQHTVHRERIRQPLVKTGGAFVETSWEVALGLIAERFKRLQKSYGQDAVGVFGGGSLTNEEAYLLGKFARLALGTRYIDYNGRYCMSSAAAAANLTFGVDRGLTNELREVEDAECIVLAGTNLAECQPTLMPYLRRAKKNGAFIIVLDPRETGTTKIANLHLKPKPGTDGAIAAGMLKVLIEEELIDRTFIEARTNGFEQVESELQEIALAELALAAGVPEEQIREAAIRFGEAQTGMIFTARGVEQQATGTADVRQFLHILLATGKIGRYACGYGAVTGQGNGQGGREHGQKADQLPGYRSIESPEDRAYIASVWNVEEKDIPRKGVSAFELFQKIDQQDVRGMFIMGSNPVLSSPHENLVKRALSRLDVLVVVDMFISETAEYADIILPTTSYLEDEGTMTNFEGRVVHRPGSKPPFGKAKHDWQILCELAEALDRSHGFQFSSPEEIFNELCLASKGGKADYSGLSYEKIKGEGVLWPCPTKEHEGTGRLFEDRFYTEDGRAQFGSVHCPVDSENDEYPILLTTGRVLTQYLSGTQTRRSDALLFKEPEPFVLLHPETASSYQIQDEDWVMVRSPYGEAKLKARQSEGIREDTVFVPFHWAGSVSINHVVAPELDPTSRMPAFKRTKVKLKKIIEEKGESWYSGQKNDRQESENTDDILDPVHSGGVAKNR

SEQ ID NO: 27252 - protein, 327 aa, Pseudomonas putida
MQLGIVGLGRMGGNIARRLMRAGHRTVVHDRNREAITGLEGEGAQGAHDLGALVQKLKAPRAVWVMLPAGEPTEQTIAQLAELLEPGDAIIDGGNTFYKDDMRRAAELAKRGLHYLDVGTSGGVWGLDRGYCMMIGGEKDVFERLEPLFKALAPGVGDIPRTHGRSGEHQRAEHGYIHAGPPGAGHYVKMVHNGIEYGLMQAYAEGFDLLRSKGGDELPEDQRFDLNVAEIAEVWRRGSVVTSWLLDLTADALVADPQLSQFSGSVSDSGEGRWTIDAAVEQAVPVPVLSSALFARFRSRQQQGTYGDKILSAMRLGFGGHVEKKAE

SEQ ID NO: 27253 - protein, 412 aa, Oryza sativa
TFPMGKNGKKTESHRQGRGRRASRFRGGGGGGDEDGDELPSSAYDAPPPHHEDSDGDDTDEAAAEDEHEGGVDGGDQEQREVGSMPSKFHLYQLSVQSPKGDISYLQKFFLMYVGGRVPLHFQEDFCGTALLSAEWLRTDARRTAVGLDLDLESLEWCLENNLSKIGADGYSRMLLFHGNVLQPNVARLVKQKICDAMQDLHVNNDNDSLASNICDQLDPASPKCSANSTMSDLVLPARDIICAFNYSCCCLHRRKDLVLYFRHAFNALSKRGGIFVMDVYGGTSSERKLRLQRRFPSFTIQLCIQYFWEQEEFDIISHQTRISLHFQAGKKQMLRHAFTYHWRLWSIPEIKDCLEEAGFKSIHVWIREMPNTQSSGNAKEYNANRDVKYEELQHFNQADAWNAYVVGVANI

SEQ ID NO: 27254 - protein, 275 aa, Glycine max
  misc_feature (207)..(207): Xaa can be any naturally occurring amino acid
MSNLQLQIHSPPPSLLSYSSSSLSSSSSLKLFPNHPFSSKSLPFNTPKPFSLRCRHSDLFDQNTLASTPRPTRPSASVGALPPRVYVGYSIYKGKAALTLTPRPPEFMPLDSGAYKISKEGYVLLQFAPAVGTRQYDWNRKQVFSLSVGEMGSVISLGARDSYEFFHDPFKGKSDEGKVRKILKVEPLPDGSGHFFNLILTLLWNFXGVQNNLVNVDESIYIPVTKAELAVLTSTFNFIMPYLLGWHTFANSIKPEDNGVNNANPRYGGDYEWNR

SEQ ID NO: 27255 - protein, 221 aa, Cyanidioschyzon merolae
MMKIQQLLEAGVHLGHQAKRWNPKMLPYLYTQRMGIHIIDLVQTAHLLNQACETLTVQVSEGKRVLFVGTKPQASVVVEEEATRCGEFFINQRWLGGLLTNWTTVQSRLKRWRELLEADMDHLTKKEASALRRELNQLNRQMRGIQNMDQIPDIVIVVDPNKENTAVLECHKLGILTIGIVDTNADPESVDLAIPANDDAIASLQLILSCLADAILKGKSI

SEQ ID NO: 27256 - protein, 376 aa, Triticum aestivum
CLSVSKQEIHAVLSSNVPPKLVILHMNMALHVYDDIMRMTENLSEKYIIGYGASSTVYKCVLKNCKPVAIKKLYAHYPQSVKEFETELETIGSIKHRNLVSLQAYSLSPAGNLLFYEYMESGSLWDVLHAPSSKKTKLDWEARLQIALGTAQGLAYLHHDCSPRIIHRDVKSKNILLDKDYVAHLADFGIAKSVCISKTHTSTYVMGTIGYIDPEYARTSRLNEKSDVYSYGIVLLELLTGKKPVDNECNLHHLILSKAADNTVMEMVDPDITATCKDLGEVKRMFQLALLCSKRQPSDRPTMHDVVHVLSCLVCPEAPPKPAQPPASPQSSTAPSYVNEYVSLRSGSALSCANSSSASDAELFLKFGKAISQNTE

SEQ ID NO: 27257 - protein, 949 aa, Robiginitalea biformata
MKTAQFASRHLGIRPGDLPAMTGRIGVENLEQLIYETLPDGIRLKGPMQLDPPMAEHEFLQHIHELGRENDLMKSYIGLGYHPTITPSVIKRNILENPGWYTAYTPYQAEIAQGRLEALLNFQTVVSDLTGMELANASLLDESTAAAEAMAMIFELRSREQKKTGCVKFFVSEGVLPQTLALLETRSAPLGIELVPGAPETARLDGDFFGALLQYPAADGSVGEFGDFVAQAHSLDIKVAVAADLMSLCLLVPPGEFGADVVVGSTQRFGIPMGYGGPHAAFFATREAYKRQIPGRIIGLSKDVDGKPALRMALQTREQHIKRDKATSNICTAQVLLAVMAGAYAVYHGPDGLRRIAGNIHAAAASLAEGLEKMGVSLRHSSFFDTVTAEVPAGAVRKEAEAAGINLNYFGDGVSVSLNETTGPWDIADILEVFARALGTDSPGCTDFSAESRIPAGLRRATDFLGQDVFNRYHSETEMMRYLKKLERKDLALNHSMISLGSCTMKLNAATQMLPLSMAEWGNLHPFVPVSQATGYQKMLRKLEAYLTEITGFAATSLQPNSGAQGEYAGLMVIRAYHESRGEGHRNVCLIPASAHGTNPASAVMAGMKVVVTKTDDKGNIDVADLEEKVAAHSDSLAALMVTYPSTHGVFESSIRQVTQLIHDNGGQVYMDGANMNAQVGLTNPATIGADVCHLNLHKTFAIPHGGGGPGVGPICVAPQLAEFLPKNPLVETGGKHGIPAISAAPWGSALVCLISYAYIRMLGAEGLTQATKIAILNANYIKERLREAYPILYTGELGRAAHEMIIDCRPFKKMGIEVTDIAKRLIDYGFHSPTVSFPVAGTMMIEPTESESLEELDRFCDALLSIRREIDLSGEQPNPILKNAPHTADMVTADTWDYPYSRAEAAFPLPHVRENKFWPSVRRVDDAFGDRNLMCTCAPLEAYAETVE

SEQ ID NO: 27258 - protein, 450 aa, Geobacter sulfurreducens
MSPHQVDEKLQGIYQDVLKRNPGEVEFHQAVAEVLESLGPVVTKHPEYLERKIIERICEPERQIIFRVPWQDDKGQVHINRGFRVEFNSALGPYKGGLRFHPSVYLGIIKFLGFEQIFKNSLTGMPIGGGKGGSDFDPKGRSDDEIMRFCQSFITELYRHLGEHTDVPAGDIGVGGREIGYMFGQYKRITNRWEAGVLTGKGLKWGGSLVRTEATGYGATFFINEALKVRKDSFDGKICTVSGSGNVAIYTIEKIHQLGGKCVACSDSNGVIFHEKGLDLDLIKQLKEVERRRIEDYASYHKDAKYIAGGNIWDIPCQVAMPSATQNEINGKDAKTLVKNGCIAVGEGANMPTTPEGVKVFLDAKIAYGPGKAANAGGVATSALEMQQNAQRDSWSFEDTEKKLENIMKGIHRLCHETAEEYGATGNYVLGANIAGFTKVADAMVAHGLV

SEQ ID NO: 27259 - protein, 180 aa, Vitis pseudoreticulata
MASSMVSSATVATINRATPAQANMVAPFTGLKSLSTFPGTRKANTDITSIASNGGRVRCMKVWPTEGLMKFETLSYLPPLTDEQLSKEVDYLLRMNWIPCLEFTKLYPYPHREHNRSPGYYDGRYWTMWKLPMFGCTDSAQVIKEVQEARTEYPNAHIRIIGFDNNRQVQCIAFIAYKPS

SEQ ID NO: 27260 - protein, 331 aa, Coccidioides immitis
MSRYAEVHKQPAGPGDARPTALQVIEDEGLEGNMKDKVFLITGCSSGIGIETARAIAATGARVFLAVRDLTRGRTACESFLEPGRVELLQLDTSSLSSVKAAASNFLEKSQTLNVLICNAGIMMIPTYEESADGFEIQLATNYLGHFLLFWLLKEAMLKASTPDFNSRLVNVSSSGHHASEVQFEDINFHRGGAYAPSKAYGQSKLAQIYMANYVDRHYGPAGLHALSLMPGGIFTNLQKHVPQEIKDGWTSNPEIMMVLKSHEQGAATTVVAAVAKEWEGRGGKYLEDCEASSPEALVQGFRGFKEYAFDEGKEERLWELTLDMLGLAEA

SEQ ID NO: 27261 - protein, 635 aa, Fagus sylvatica
MESCDCIETQWHDELLVKYQYISDFLIALTYFSIPLELIYFVQKSAFFPYRWVLMQFGAFIGLCGATHFISLWTFSMHSKAVAVVMTVAKIACAIVSCATALMLVHIIPDLLSVKTRELFLKNKAEELDREMGLILTQEETGRYVRMLTHEIRSTLDRHTILKTTLVELGRTLGLEECALWMPSRTGMNLQLTHTLNSQIQGSTVPLSDSIVNEVFNNARAMRIPYTCPLARFRPLVGRYVLPEVVRVPLLPLSNFQINDWPDLSAKSYAIMVLILPTDGARKWRDYELELVDVVADQVAVALSHAAIIEESMRARDQLMEQNVALDLARREAERAIHARNDFLAVMTHEMRTPMHATIALSSLLLESELSPEQRVVIETVLKSSNLLATLINDVLDLSRLEDGSLELEIGTFNLHGVFREVLNLIKPIASVKKLSMTLLLTPDLPVCAVGDEKRLMQTVLNVAGNALKFTKEGYVSIIASVAKPESFRDWRAPEFYPIASDGHFYLRVQVDKDSGCGILPQDIPHLFTKFTQSQSGSNRRNGGAGLGLAICKRIRFVNIMGGHIWIESEGPDKGSIATFIVKLGICDNPNDSALQQVAPIGRAHNASGDLTGHKPVSRDIVNMDSSNLRYQRSF

SEQ ID NO: 27262 - protein, 513 aa, Geobacter metallireducens
MPDKSLKKPFVHLIGAGPGDPGLITVKGRESLGRADVVIYDYLANDDLLRFARPDAELIYAGKIGGHHNREQWQINALLVEKALAGNVVARLKGGDSFVFGRGGEECEALVAAGIPFEIVPGVTAGIGVTAYAGIPLTHRGVTTSVTFVTGHEGHDKEVSQIDWEGLSLGSGTVVFYMGIKNLPQITANLMAHGRPPETPVALIRWGTRPEQEVLTGTLADIAEQARRTGFRAPAITVVGEVVRLREKLRWFDNRPLFGTSILVTRAADQAGEFGAMLGALGARVLECPTIAIVPPESWDNLDAAIASLDRFHWAVFTSVNAVRFFFERLAAAGKDSRALGNCRVCAVGPKTAAALAPFGIRPDLIPADYKGEGVVEVFRSEEIAGKRIIFPKGDRARDVIPQGLAELGGEVTAPVAYRNVTPDSLPAGVIAELEERRITCVTFTSSSTVENLAAILGENRFLHLLKGVTIAAIGPITARTCRELGLEVHVEPSKYTLAAMTDALVDFFSRSK

SEQ ID NO: 27263 - protein, 371 aa, Robiginitalea biformata
MEQSVTIYGKRFNHFIPESEILRAVEKVAAEIAEDYRDAVPVFVGVLNGAYMFVSDFMKHYPHPCELTFVKLSSYRGLTSTGIVETLLDLPEQVEGRHVIILEDIVDTGRTLQELVHLFANKNVKDFRIATLFYKSEIYNGEYPIDYFGLEIPDKFIVGYGLDYKEQGRNLRDIYQLNKPPMINLVLFGKPGAGKGTQAAFLKEKYDLKHISTGDVFRYNIKNGTELGNLAKSYIDKGDLVPDEVTIRMLQEEVEKNPEAAGFIFDGFPRTVAQAEALDDFLRTKDMQIDATIALEASDDVLLERLLERGKVSGRSDDQDPEKIKNRFREYNEKTAPLKSYYEEQDKFYSVNGIGEIQEITDRLAGVIESL

SEQ ID NO: 27264 - protein, 473 aa, Aspergillus fumigatus
MANSFPLRVLPTIDPSAGHTFITPSKRIHESEDVSEFLISKAYVDIMTFLLQLNRAMIPVKLADGTVQSWPINTDAVEFSAPVRQLQQLLTKLEELLAEAPPDTGPRRFGNISFRRWYELVESRASELLGECLPSELLQAKSSDPNSVTAEAELKAYFLGSWGSPQRLDYGTGHELSFLAFLAGIWKLNGFPKTTPGVEERAIVLGVIQPYLELVRTIIKRYTLEPAGSHGVWGLDDHSFIPYILGSAQLAPAISETDPTPEEGSLPGAPSPNGVTKAHIVERERLTNMYFSAIGFIYDVKKGPFWEHSPMLYDISGIQAGWGKINKGMIKMYNAEVLSKFPVVQHFPFGSLFSWDRDPNAVPPPTSAHMSTTQSQSRGPAVPSAGQTPPSGTRAPWATATQAAPPAGAGTAAPWAAKRDGCTPGKPPTSLPDTSRLPPGPMAPTRAPWAASSTGQAPGGDPTHVPTKAPWAK

SEQ ID NO: 27265 - protein, 453 aa, Atriplex hortensis
MSSYDPENAATNGVPPVKNDNSNHQQQHQQTVVVPETAHQISTDSWLQVGFVLTTGINSAYVLGYSGAIMVPLGWIPAVLGLIAATLISLYANSLVAKLHEYGGKRHIRYRDLAGFIYGPKAYSLTWALQYINLFMINTGFIILAGSSIKAAYHLFTDDPALKLPYCIIISGFVCALFAIGIPHLSALRIWLGVSTFFGLIYIIIAIALSLKDGINSPPRDYSVPTERGKVFTTIGAAANLVFAFNTGMLPEIQATVRKPVVGNMMKGLYFQFTAGVVPMYAIVFIGYWAYGNKTDSYLLNNVHGPVWLKALANISTFLQTVIALHIFASPMYEYLDTRFGITGSALNPKNLGSRVLIRGGYLAVNTFVAALLPFLGDFMSLTGAISTFPLTFILANHMYFKAKRNKLSMAMKIWLWINIVFFSCMAVASFIAALRLIATDSKQYHVFADLEG

SEQ ID NO: 27266 - protein, 478 aa, Aspergillus oryzae
MAADGLPVRVLPTLDPSEGHTFLEPSKRINEGDDVSEFLCSKAYVDIMTFLLQLNRSMFPAKLPDGRVQTWPLNTEAVGFSAPVRQLQQLLSKIEDLLDATPLMPGEWRYANGAFQVWHDKVKKATPSLLAECLPAEILHAPSSDPNGPTAEVELTEYFLGSWGSRERMDYGTGHELSFLTFLGAIWKLNGFPKNEPGVEERTIVLGVIEPYLELIRAVIKKYKLEPAGSHGVWGLDDHSFIPYIFGSAQLGPAISNSDLVPETGSLPDAVDPDGVTKANVVEKERKVNMYFSAIGFINDVKKGPFWEHSQMLYNISGVQAGWAKINKGMIKMYNAEVLSKFPVVQHFRFGSLFSWNRDPSAIPPPSRIHTSSGPETRPRQVPPSARQDPGPGTKAPWATASQSTPPPSTGTAAPWATSRAGREPPTTSRIPSALPDTSRLPPGPMAPTRAPWASSQPAGPAPTGDPNDITTKAPWAK

SEQ ID NO: 27267 - protein, 465 aa, Chlamydomonas reinhardtii
MGSCLAKPAESAEQKKASSVPSPPPAPAPQPVQQAAAPAPKDSGDVKPGQQATPVPPPSPPPQPKPAPPAQPAPAPAAKVVEAIPAVADEKSPQGKQPRRSQEHDNGVKAEEIELVKQKSTEPQPSASATAAVATPKAIEPAMEPKVAAPSAPAAAPAPAQAPAAAPTPARPGSKLRTDVKLRDLYKLGKTLGTGGFSVVKLATDRGTGVEYACKIMALPPVGQEVGENENTREDIFKEIDLLCGMNHENVIFLKEYFEEGNKVYLITELLTGGELLEAVLKRGSYTEAEARLCFVQVLRGIEYLHSKNVVHRDLKLENLLLAKQDDISLVKIADFGLAKHAVNGMQTICGTPQYVAPEVIVGAKGHVYGPGVDMWSAGVVLYILLGGYPPFWSDSEPQLFDMIRKGKYSFGDPVWNKVSEGAKDLIRKLLVVDPTKRLSATEALQHQFILEGNFNPPSTPKGPR

SEQ ID NO: 27268 - protein, 240 aa, Atriplex hortensis
MSYSYPPPLPSNTLNNFLSPKPVTMKTTGGPPKPTKLYRGVRQRHWGKWVAEIRLPKNRTRLWLGTFDTAEEAALAYDKAAYKLRGDFARLNFPNLRHEGSHIGGEFGEYKPLHSSVNAKLEAICESLAKQGNEKQGKSGKSKKKDVANNNNNTSSSSSSSCCTTATAAADAPQQQQRMPENGGDVKTESTSDSEVGSGGSSPLSDLTFGDNEEMGSENFLLESCPSHEIDWDAILSSES

SEQ ID NO: 27269 - protein, 301 aa, Saccharophagus degradans
MSRSFLAAVVQQAIGGNDKAENMAATAEHVREAANSGAQLVVLQELHATQYFCQVEDTECFDLAEDLDGETYEYFAELAAELDIVLVISGFECRAPGLYHNTAQVIDGDLGRVGFFRKMHIPDDPGFYEKFYFTPGDADAPGCGFEPVETRLGKLGVMVCWDQWYPEGARLMAMAGADVLIYPTAIGWDPDDDEDEQERQRDAWVTIQRSHAIANGLPVLVANRTGFEASPVDDGTGIEFWGTSFIAGPQGEFLALANCEEQGPLCAQIDLKRSEDVRRIWPYFRDRRIDAYKGLTKRWLD

SEQ ID NO: 27270 - protein, 422 aa, Aspergillus oryzae
MASEVSASQGVPKPKIDLSKKLSELRSNRKSQPALPSRPSREPAPVTPPLSNPPDLSSHQYARPVCRILSNHDHQLFLSSSSYSLILAFIFGLSDSVRGRATTDSKDRPVSPNVSKILAVVESIRTLLDQHPSIDQGGSRFGNPAFRDLFDDVAAQSAKWHREILGIQDSTAIEEASAYLIHSLGSRDRLDYGSGHELNFMMWLLCLRQMQLYSTADFEMIVFRVYVTYMHLMRDVQSAYYLEPAGSHGVWGLDDYHFLPFLFGAAQLVEHPYITPLAIHNNVILDEEGDRYIYLDQVRWVDSVKTVKGLRWHSPMLDDISGAKNWSKIESGMKKMFVKEVLGKLPIMQHFLFGSLIPAAPGMGEADDVQTDGHDHTHSHDHAHAQHTDHFGDCCGIKVPSTVAAGAEARKRGTGLRPIPFD

SEQ ID NO: 27271 - protein, 175 aa, Crocus sativus
MGKSSPTVSAEYLKAVEKCKRKLRGFIAEKNCAPLMLRIAWHSAGTFDCKSKTGGPFGTMRHKAELAHGANNGLDIAVRLLEPIKEQFPIISYADFYQLAGVVAVEITGGPDVPFHPGREDKPEPPVEGRLPDATKGCDHLRTVFGEQMGLSDKDIVALSGGHTLGRCHKDRSGF

SEQ ID NO: 27272 - protein, 420 aa, Emericella nidulans [sequence omitted]

SEQ ID NO: 27273 - protein, 279 aa, Oryza sativa
MRERRKEPGGEEKIDLNARMDELAEIAGWDELKLLGTWPSPFVTRVELALALKGLSQDLVGMSDLLLASNPVHKKVPVLIHNGKPICESRIILEYIIDEVFPVDGAALLPADPYDWAVARFWAAYIDDKAMCPFAITHAMADNVHAVHFVAPWAPMFKGKTEEEKAEGIKQILAAVETLEGALKGCSKEKPFFGGGTVGLVDIMLGAHIPGVRATEVLTGAKIFNAAITPLLASWTERFGELDAPKKVLPDVDGMVEYVKRRQAQWAAAGAAAAAASKS

SEQ ID NO: 27274 - protein, 71 aa, Thermus thermophilus
AKEKDTIRTEGVVTEALPNATFRVKLDSGPEILAYISGKMRMHYIRILPGDRVVVEITPYDPTRGRIVYRK

SEQ ID NO: 27275 - protein, 492 aa, Arabidopsis thaliana
MSDLQANKDAAAVDRQSSSSLVDLDGPSPLRKMISVASIAAGIQFGWALQLSLLTPYVQLLGVPHKWSSFIWLCGPVSGLLVQPSVGYFSDRCTSRFGRRRPFIATGALLVAVAVVLIGYAADFGHSMGDKIDEPVKMRAVVIFALGFWILDVANNTLQGPCRAFLGDLAAGDAKKTRTANAFFSFFMAVGNVLGYAAGSYTNLYKIFPFTMTKACDIYCANLKSCFFLSITLLLVVTIIALWYVEDKQWSPKADSDNEKTPFFGEIFGAFKVMKRPMWMLLIVTALNWIAWFPFLLYDTDWMGREVYGGDSKGDDKMKKLYNQGIHVGALGLMLNSIVLGVMSLGIEGISRKMGGAKRLWGAVNIILAVCLAMTVLVTKKAEEHRRIAGPMALPTDGIRAGALTLFALLGIPLAITFSIPFALASIISSSSGAGQGLSLGVLNMAIVIPQMIVSFGVGPIDALFGGGNLPGFVVGAIAAAISSVVAFTVLP

SEQ ID NO: 27276 - protein, 917 aa, Pseudomonas fluorescens
MLKKLGIKGRVLLLTLLPTSLMALVLGGYFTWMQQSDLHAQLLQRGEMIAEQLAPLVAPAMSRQDTDLLERIATQSLEQADVRAVTLLAPDRTPLAHAGPTMLNRAPEGNSAQLQQRTGNDATRYLLPVFGKHRNLAGELIPEEADRLLGWVELELSHSGMLLSGYRSMFASLLLIAVCLGLTALLALRMGRTINRPLSQIKHAVAQLKDGHLETRLPPLGSQELDELASGINRMAGTLQNAQEELQHSIDQATEDVRQNLETIEIQNIELDLARKEALEASRIKSEFLANMSHEIRTPLNGILGFTHLLQKSELTPRQLDYLGTIEKSADSLLGIINEILDFSKIEAGKLVLDNIPFNLRDLLQDTLTILAPAAHAKQLELVSLVYRDTPLSLVGDPLRLKQILTNLVSNAIKFTREGTIVARAMLEDEHEDSVQLRISIQDTGIGLSNQDVRALFQAFSQADNSLSRQPGGTGLGLVISKRLVEQMGGEIGVDSTPGEGSEFWISLRLPKTRDDAEDLPGPPLLGRRVAVLENHELARQALQHQLEDCGLQVTPFNTLESLTNGITVAHQTDQAIDLAVLGITSNDMPPERLNQHIWDLEHLGCKVLVLCPTTEQTLYHLSVPNPHSQLQAKPACTRKLRRSLSDLVNPRPTRSEPHEPVASRAPKVLCVDDNPANLLLVQTLLEDMGAKVLAVESGYAAVKAVQKETFDLVLMDVQMPGMDGRQNTEAIRQWESERHCTPLPIVALTAHAMANEKRALLQSGMDDYLTKPISERQLAQVVLKWTGLALRNQSPDRGGDAQGNGSELLVLDHEEGLRLAAGKADLAADMLAMLLASLEADREAIRQASEANDHNALIERVHRLHGATRYCGVPQLRAACQRSETLLKQQDPKAAAALEELERAINRLASEARISA

SEQ ID NO: 27277 - protein, 804 aa, Prunus avium
MKGKQVQVHHHQDLHAGDLHHHHMKDVNIPISDGFGGGGAMEELEDQEDNLGVDPREMWLDDNDQETAFLADVNDPSIFYNDHFPPLPDFPCMSSSSSSSSTPAPVKPVTSSSTSSSISSSSSAASWAILRSDAEEDGERRQQQHHNSYNHRYQYSQVDDQAVDAHALSSTASMEISQPSDLGREGGAIDCMGAMETFGYTDLFESNEFFDLSSIFQSDSLLMEQFQQDDDHQQLLTPHQLQDPNEATAIIPQQQQQQEVAVRDEENNKKDDQNENKEPDDMAMVFLEWLRSNRETVSAEDLRSVKIKKSTIECAARRLGGGKEAMKQLLKLVLEWVQTNHLQKRRSNSLTTKDANIVAQQQQYHDPFQNPNPNTSPRVLEPNPSCSFTQTPWMAPPPHAAYDHAGESLSPLRPRRPPPAAYPSMMGYIAPDQYVNGPGPYQPSPEYHHMIDSGQPTWPSSPFGMGTAHYGSFPDNNIHLAPPPQHRPQAFAGYGSQYQPYQYFPGNGEHQLMRLGSSATKEARKKRMARQRRLVSHHRHGHHHQQQHLNAQMPDHLLHQQHTRLVGNAANLNCANSVPLQANPGNWFYWATATAAPSPSPAMMPSITPEAAPPPPVQQMDRPASTQAQNYNQGRSAAQERQERRQGWKSEKNLKFLLQKVLKQSDVGSLGRIVLPKKEAETHLPELEARDGISIPMEDIGTSRVWNMRYRYWPNNKSRMYLLENTGDFVRANGLQEGDFIVIYSDVKCNKYMIRGVKVRQAGPKSEGNKRPGKSQRNQHASTPAGTNGSSPSSASASATHKKQ

SEQ ID NO: 27278 - protein, 171 aa, Haloarcula marismortui
KPASMYRDIDKPAYTRREYITGIPGSKIAQHKMGRKQKDADDYPVQISLIVEETVQLRHGSLEASRLSANRHLIKELGEEGDYKMTLRKFPHQVLRENKQATGAGADRVSDGMRAAFGKIVGTAARVQAGEQLFTAYCNVEDAEHVKEAFRRAYNKITPSCRIDSSPAGNA

SEQ ID NO: 27279 - protein, 219 aa, Nicotiana plumbaginifolia
MESNNVVLLDFSGSSFGMRLRIALALKGIKYEAKEENLSDKSPLLLEMNPVHKKIPILIHNGKPICESLNILEYIDEVWHEKCPLLPSDPYQRSQARFWANYIDNKIYSTGRRVWSGKGEDQEEAKKEFIEIFKTLEGELGNKTYFGGDNLGFVDVALVPFTSWFYSYETCANFSIEAECRKLVVWQNCMENERVSKSLPHPHKIYDFVLELKHKLGLA

SEQ ID NO: 27280 - protein, 418 aa, Arabidopsis thaliana
MEDGIGGLRHMLATVFLSAFAGFMVVPVITDVTVAAVCSGPDDSCSLAVYLTGFQQVAIGMGTMIMMPVIGNLSDRYGIKTILTLPMCLSIVPPVILGYRRDIKFFYVFYISKILTSMAVNIHGSTRISAFGILAGIKTIAGLFGTLVARFLPIALTFQVSAISFFVGLVYMRVFLKEKLNDDEDDDLHHGTYHQEDHDSINTTMLAEPILNDRPIKTQVFHKKYSSLKDMISLMKTRYYFLKARFGFDKKQFADLLLLITIVGSISQLFVLPRFASAIGECKLLSTGLFMEFINMAIVSISWAPWVPYLTTVFVPGALFVMPSVCGIASRQVGPGEQGKVQGCISGVRSFGKVVAPFVFSPLTALFLSKNAPFYFPGFSLLCISLSSLIGFFQSLLIKDVPTPPLNKAINKTSGEEV

SEQ ID NO: 27281 - protein, 219 aa, Nostoc punctiforme
MFSVVLLGCFAFTVPSVAQAQVLVAQAKNPQLKQLLEEGRRLVDSGDYSGAIAVYQQAASLDPKNAKIHSGIGYLYAQQGNYQAALTSYRRAIAINPNNSDFYYAVGYIKANLGDTAGAKEGYRRAIQLNRNNVNAYLGLAVTQSRMGDYTAATWAYQQAIDLDKNNAQTYELMGSMYKQRRQTKQANSLLQKARDLYKRRNDLQGVDRVEAMLRQLGG

SEQ ID NO: 27282 - protein, 211 aa, Magnaporthe grisea
MADLGGFLPNAVVLIGDSGVGKSNLLSRFTRNEFNLDSKSTIGVEFATRSIQVDSKTIKAQIWDTAGQERYRAITSAYYRGAVGALLVYDISKHQTYENVTRWLKELRDHADANIVIMLVGNKSDLRHLRAVPTEEAKAFASENHLSFIETSAFDASNVELAFQNILTEIYRIVSSKALDSGDTPSMPQTGTNIALSNPTEDSAAKNGKCC

SEQ ID NO: 27283 - protein, 468 aa, Nostoc punctiforme
MTKIIWQQGELIEVTIANLSDTGDGVGRADERVVFVPDTVPGDRAIVRLVHVKPKYAHGKLQELLEPSSHRIRPNCIVADKCGGCQWQHINYDYQLVAKQNQVIQAMERIGGFVQPPVNPVLAAPSALGYRNKSTYPLGTSATGQVQAGYYQKGSHQLINLNQCPVQDARLNPLLAEVKQDIQRQGWQIYDEQRHQGKIRHLGLRIGRHTGEMLLTLVVKDWNLSGIETQAQEWLKRYPQLVGVSLNRNSDRTNAIFGSEIRCIAGVPHLRENFAGLEFQVRPDTFFQVYTETAEALLQVIQSELNLQGHELLVDAYCGIGTLTLPLAKKVRIATGLEVQPAAVEQALLNAHCNGIDNVTFLVGAVEKLLPKMGTIPEVVILDPPRKGCDRAVIDTLRQLKPSRIVYVSCKVATLARDLKLLCQDGQYTITRVQPADFFPQTAHVEAAAFLVLSDLHKDSNSFKKTEI

SEQ ID NO: 27284 - protein, 388 aa, Arabidopsis thaliana
MLSSIKPSSSSFSTAISGSVRRSIPTKLKFSPLLIIKNCHNQSFNANVVSHQKPLHISSASNFKREVKVEAYEADRSRPLDINIELPDEQSAQKLKIGIYFATWWALNVVFNIYNKKVLNAFPYPWLTSTLSLACGSLMMLVSWATRIADAPKTDLEFWKTLFPVAVAHTIGHVAATVSMSKVAVSFTHIIKSGEPAFSVLVSRFFMGETFPLPVYLSLLPIIGGCALAAITELNFNITGFMGAMISNLAFVFRNIFSKKGMKGKSVSGMNYYACLSMMSLVILTPFSIAVEVPQMWAAGWQNAVSQVGPNFVWWVVAQSVFYHLYNQVSYMSLDQISPLTFSIGNTMKRISVIVASIIIFHTPIQPVNALGAAIAIFGTFLYSQAKQ

SEQ ID NO: 27285 - protein, 523 aa, Methylobacillus flagellatus
MIACCLALVPIHPNSKEAIIMSTNTADIGLIGLAVMGQNLALNIADHGYTISVYNRDPEKTRKFIAHCKENEPSADNLKGFEDLATFVLSIKRPRKIVLLVKAGSATDVTINALVPFLEEGDIIIDGGNALWTDTIRREKELRAKGLEFIGSGVSGGETGARFGPSLMPSGTRKAWFHLEPIWRDIAAKVDPRTGKPIEGAAPGKPVQGGFSCAEYIGPDGAGHYVKMVHNGIEYIDMQLICEAYWLMKNLLGMRADEIGQVFEEWNKGELSSFLIEITGDILQQKDPAGDGFLVDKILDAAGQKGTGQWTAANALELGSPANAIAAAVFARALSTLKAERVEASTILKGPTVKLESDREQLIEAIRNALYCSKICAYAQGFQLMDKAQVAYNWKLNFGEIAQIWRGGCIIRARFLQKITDAYALDSRLKNLMLDPYFTEALDEGQASWREVVTLAVRNGIPAQAFCAALSYYDGYRSASLPANLLQAQRDYFGAHTYERTDQPRGEFFHTDWPEPGRPQFKV

SEQ ID NO: 27286 - protein, 463 aa, Nostoc punctiforme
MVNRRIAEILRSGQPDESFQVQGWVRTKRESKGFAFIEVNDGSSLANLQVVINQDLPDYEAILKKLNTGAAVEATGVLVASLGKGQRIELKAESVKVYGEADPDTYPLQKKRHSFEFLRTIGHLRSRTNSFGAVFRVRNACSTAIHQFFQQRGFLWVHTPIITASDCEGAGELFSVTSLDLKNIPRTENQAVDYSQDFFAKPTYLTVSGQLEAEVMAMAFSNVYTFGPTFRAENSNTSRHLAEFWMVEPEMAFCDLEGDMDLAEAFLKHIFKYVLETCPEDMEFFNERIDKSVLATAENIINNQFERLTYTEAIKVLEKADVKFEYPVSWGLDLQSEHERYLAEQQFKKPVIVTDYPAQIKAFYMRLNDDEKTVRAMDILAPKIGEIVGGSQREERLEVLERRVLAQGLKPEELWWYLDLRRYGTVPHAGFGLGFERLVQFMTGMGNIRDVIPFPRTPQSAEF

SEQ ID NO: 27287 - protein, 112 aa, Burkholderia vietnamiensis
MKLITAIIKPFKLDETREALSALGVSGITVTEVKGFGRQKGHTELYRGAEYVVDFLPKMKIEAAVSDDLVDQAVEAIERAARTGKIGDGKIFVTPIEQVIRIRTGETGADAL

SEQ ID NO: 27288 - protein, 529 aa, Geobacter sulfurreducens
MNAHELWQRYQTYLLFDADTGLILDVSRMAFSDDFFASMEPAMQRAFDAMERLEAGEIANPDENRMVGHYWLRSPELAPDPAIAAAIRETVDRVTAFAADVHNGVVTAPRARLFRNVLVIGIGGSALGPQFVADALGGHGDRMRPFFFDNTDPDGMDRVLETLGADGLAETLAIVISKSGGTKETRNGMLEAEAAYRRAGLDFSRHAVAVTGAGSELDRTAEAGGWLCRFPMWDWVGGRTSETSAVGLLPAALQGIPIRDFLDGARTCDTLTRRRETLRNPAALLALMWHHATRGSGSRDMVVLPYKDRLLLFSRYLQQLIMESIGKELDLDGTVVNQGLTVYGNKGSTDQHAYVQQLREGTNNFFVAFIEVLKDREGASLAVEPGFTSGDYLSGFLQGTRTALSEKGRESLTITIPAITPRTVGVLVALFERAVGLYASLVNINAYHQPGVEAGKKAAGGVLALTGEALAFLRREGGTLSATEIAAALGRPEEAETIFRSLLHAAANPDHGVVMEAASPLTRSRFSAR

SEQ ID NO: 27289 - protein, 338 aa, Solanum demissum
MGRSKCCDEEGLKKGPWTHEEDQKLLSFIDKYGCGSWRGLPAKAGLQRCGKSCRLRWINYLRPDIKRGKFSLQEERTIIHLHAFLGNRWSTIATYLPSRTDNEIKNYWNSRLKKRLMKMGIDPMTHKPNAAGSSKYVANLSHMAEWESARLEAEARLVRKSKILFNKNNNSHNYNINPTTISQQLPYHQQLPCLDILKAWQMTSTKLPTINDISHAILLNNSRNKNLESSIPSTLNSSENIFANNVPTTTKVADDHQNLHNLSTINSCFEDDQLQTELPSFMQEFSGVFPEYTQNSTNGLQVDNIMGSFYGDFEDNKLINWNNFPNYLVNSPIGSPVF

SEQ ID NO: 27290 - protein, 483 aa, Rhodopseudomonas palustris
MLTPASSRPLIVWFRDDLRLADHPALHAAAQSGAPVLCVYVLDEVSDDVRALGGAVRWWLAQSLRALESELRALGGALILRRGPTAAVLAELAQQHDAAAVHWNEIEIAAHRAVADALADALTVAGIAYHRHRGDTLVEPSAIRSKDGRGMRVFTPFWRRVLSLGDPPQPLPRPTTLRPAPAVPTEQLSDWQLEPTAPDWAGGLRQTWTPGEAAAQTRLAAFLAMQPGYAEGRDYPDRHITSGLSPHLRFGEISPRQVWYAARFAAAERPAIAPDIDKFLSEVGWREFCRHLLFDHPDLASRNLQPAFDAFPWQSDDAVLTAWQRGRTGYPIVDAGMRELWHSGVMHNRVRMVVGSFLVKHLLIDWRLGEQWFWDTLVDADPGSNPGNWQWVAGCGADAAPYFRVFNPVLQSEKFDAGGAYIRRWVPELARLPNDLIHQPWTATPLELAAAGIKLGGNYPGPIVDHKTGRQRALSAYAELRQR

SEQ ID NO: 27291 - protein, 529 aa, Yarrowia lipolytica
MRAVAPDIDIQLCSVFVNSLVPHHHIEFDKKAQMHSPSSSNNMFTGKSNVWGNSQMTRLFILTLTIAGLQFTWGVEMSYVNVYLLSLGMSKSTISLVWAMGPLAGLVTQPVVGLLSDSCTSRYGRRRPFMVVGSLFVSLSLVTMAWATELSPILFFLNKSISTRVIAVFSVFLTDFSINTVQACCRALIVDILPASLQQAGNGWAARQTAVGHLIGYFLGFLNLVHITNGWMGDTQLKCLCVISSAALLLTVGITSMLTREQVLVKTEQHEPVTLKSVLSHTCGIFTTIFKTATTLPPRMKRIVSVQFFAWYGWFSFLYYSSTWIGEVYQRQHGGVDEDGDKVGKVGRIGSMSLTVFSVVSLIASFVMPFLATNTVFRYKPRLTSIWTGAHIVFSLAMFSTLYVGSVGAATAVIASCGYSWAITTWAPFALMGEEIHRLEGTPLPISQEINETDQLGPNSSATSDAKHTGVFLGIHNIAISAPQFVCTFVSSFVFFLLEGEGDGGRAIAVTFQIGGVMTLIAAYISRAL

SEQ ID NO: 27292 - protein, 493 aa, Ralstonia metallidurans
MSHPHPHQHPVVEHDDLHRKLKARHLTMIALGGAIGTGLFVASGASIAQSGPGGALLAYCLIGLMVYCLMTSLGELAVHMPVAGSFVTYSALYVDEGFGFALGWNYWFSLAVTIAVELTAAQLVMQYWFPEVPGIYWSAGFLALMFALNAFSVKGFGEAEYWFAMIKVVTVVVFLCVGVLMILGILKGGPQSGWHNFTTGEAPFVGGLPGLFAVAMIAGFSFQGTETVGVAAGEAADPGRTIPRAIRQTFWRILLFYVVAILIIGVLIPYTDPNLLRNDVTDVGVSPFALVFQHAGLAFAAALMNAVVLTALLSAGTSSMYVSTRILYGLAVSQRAPRALAKLTPNGVPFNALLVTTGIGALCFFSSLFGDKAVYLWLLNTSAMTGFFAWLGIAVSHYRFRKGLLYQGYKVSDLAYRSPLYPFGPIFAGVLCLVIVGGQNYQAFTDIPGRWQEIVSTYIGVPVFLALWLGYRIVRGTRMIDYEDMPFELVKKD

SEQ ID NO: 27293 - protein, 175 aa, Solanum tuberosum
MASKMCEPLVIGRVIGEVVDNFCPSVKMSVVYNNNKHVYNGHEFFPSSVTSKPRVEVHGGDLRTFFTLVMIDPDVPGPSDPYLREHLHWIVTDIPGTTDCSFGREVVGYEMPRPNIGIHRFVFLLFKQKKRQTISSAPVSRDQFSSRKFSEENELGSPVAAVFFNCQRETAARRR

SEQ ID NO: 27294 - protein, 345 aa, Vibrio vulnificus
MTQTLVNNAYGKEISMTVIGAGSYGTSLAISLSRNGANVVLWGHEPEHMAKLEADRANHEFLPGIEFPPSLIVESDLAKAVQASRDLLVVVPSHVFGIVLNSLKPYLRDDSRICWATKGLEPETGRLLKDVAFDVLGEHYSLAVLSGPTFAKELAAGMPTAISVASPDAQFVADLQEKIHCSKTFRVYANSDFTGMQLGGAVKNVIAIGAGMSDGIGFGANARTALITRGLAEMCRLGAALGAQPETFMGMAGLGDLVLTCTDNQSRNRRFGLALGQGKDVDTAQADIGQVVEGYRNTKEVWMLAQRMGVEMPIVDQIYQVLYQGKDARLAAQDLLARDKKSEGK

SEQ ID NO: 27295 - protein, 532 aa, Desulfovibrio vulgaris
MESVESFKDLPLEEELLKAIEELGFTEPSPIQSIAIPRLLEGRDVIGQAQTGTGKTAAFGLPLLQRIDAADRSVQALVLCPTRELALQVANGLTALAKHLRGVRILSVYGGQPIEPQASALRRGAQVVVGTPGRILDHINRGTLQLGVVRMTVLDEADEMLDMGFREDIERILSEMPEWVQSAFFSATMPDGILELARRFLREPELLRVTRRQLTVANTEQAWFEVRPFRRVDAVCRIFDAYIPRKAIVFRATKQGVDELAAALQQRGILADALHGDLNQTQRERVMSRFRAGGISVLVATDVAARGLDVDDVDTVINFDLPNDPETYVHRIGRTGRAGRTGRAFSFAAGRDVYKLRDIQRVTGSRIDRRAMPTAADASRARTGQLLEEVAAGLASAETSACLPVVEKLIAEGADPTQLAATLLRMIMQRDRIDLPGARQTDDIGTGRVRLFFNVGRRMRITPRDLVGAIAGETGISGRSIGSIEIHDRFSFVEVDASIAPEVVSVMHGNQIRGFRLAVEQASPREGQDRAA

SEQ ID NO: 27296 - protein, 303 aa, Triticum aestivum
  misc_feature (219)..(219): Xaa can be any naturally occurring amino acid
  misc_feature (233)..(233): Xaa can be any naturally occurring amino acid
PTEQVCTKKQAGTGPEFPGYRRPTRPRTCCSGLPATPRRQAGHHTLPLPAACGLALAPEFGSYGRRGRPPPLCCTSTARTRVVASCSVPRRNVVTTLLSASTLLLLGPRQITLAETTGGAFREYIDTFDGYSFIYPKGWIQVKGAGADIFFRDPVLLDVNMSVDISSPSSSAYKTVEDLGPPEKAAEGVLKQYLTEFMSTRLGVRRESNVLSASSKVAXTMGKLYYEVEGEHXKSYASNNELTVMPKDRVQSLEWDRRYLTVLGVENNQLYALRLQTRERLLSEEKGNLRRVMDSFRATRIKG

SEQ ID NO: 27297 - protein, 404 aa, Geobacter metallireducens
MKAVEIKKDIYWVGAVDWAVRDFHGYETPRGTTYNNYLIMDDEITLIDTVKYDFATYTLKNISGVVDPARIKNVIINHIENDHVTSLDCVMDLAPNATIYISEKGKKGLERFFDLSRWNVKTVKTGDTLTIGKRTLEFLETPMLHWPDSMVTYAREDKILFTQDAFGQHVASANRFDDEYEISNSPVELEDAVVDYYANILMPFGQMIKTKIAEIQAKGFEIDIIAPDHGLIWRKDPGKVLGMYLDMANGKARESVAIIYDTMWQSTEKMAGPIAEGVRAEGLNCQIIKLRATPTSVAIKEFWKCRGALIGSPTLNNILFPSVAEFLTHLRGLRPKNRIVGAFGSFGWGGGAVKESYEVFKQMGLQTVEPGIQLAYRPSLADEEACFEFGRTFARQVSEYHKGF

SEQ ID NO: 27298 - protein, 209 aa, Unknown
  Photobacterium sp. SKA34
MSRKKQSGSSGRWLKEHFDDKYVQEAQKRGYRSRAFFKIEEIQNKDKLLKPGMTVVDLGAAPGGWSQYAAEIVGSEGQVIACDILPMDSLPGVSFLQGDFREEAVLDALLDRIQPDMVDVVMSDMAPNMSGNLASDQPRAMYLVELALDMCRQVLAPNGSFTVKVFQGEGFDQYLAEIRSMFKVVKIRKPDSSRDRSREVYIVATGYKL

SEQ ID NO: 27299 - protein, 418 aa, Methylococcus capsulatus
MFSKGMEIAGFDDELWAAIQEEERRQEDHIELIASENYASPRVLQAQGTVLTNKYAEGYPGKRYYGGCEYVDIVETLAIERAKRLFGADYANVQPHSGSQANAAVYMALLKPGDTVLGMSLAHGGHLTHGAKVNFSGKIYNAVQYGLNPETGEIDYDQVDELAREHRPKMIVAGFSAYSQVVDWQRFRAIADSVGAWLMVDMAHVAGLIAAGLYPSPVQIADVTTTTTHKTLRGPRGGLILAKANPEVEKQLNSLVFPGIQGGPLMHVIAAKAVALKEALQPDFRHYQSAVMENADAMAKTFIERGYRIVSGGTRNHLFLVDLIQKGLTGKLAEEVLGRAHITVNKNAVPNDPQSPFVTSGIRVGTPAVTTRGFGVEECRLLAGWMCDIMDCPGDETVIGQVREEVTHLCRRFPVYAN

SEQ ID NO: 27300 - protein, 127 aa, Brassica napus
  misc_feature (11)..(11): Xaa can be any naturally occurring amino acid
  misc_feature (22)..(22): Xaa can be any naturally occurring amino acid
  misc_feature (32)..(32): Xaa can be any naturally occurring amino acid
  misc_feature (37)..(38): Xaa can be any naturally occurring amino acid
  misc_feature (40)..(41): Xaa can be any naturally occurring amino acid
  misc_feature (45)..(46): Xaa can be any naturally occurring amino acid
  misc_feature (50)..(50): Xaa can be any naturally occurring amino acid
  misc_feature (58)..(60): Xaa can be any naturally occurring amino acid
  misc_feature (64)..(64): Xaa can be any naturally occurring amino acid
  misc_feature (67)..(68): Xaa can be any naturally occurring amino acid
  misc_feature (79)..(80): Xaa can be any naturally occurring amino acid
  misc_feature (83)..(83): Xaa can be any naturally occurring amino acid
  misc_feature (86)..(87): Xaa can be any naturally occurring amino acid
  misc_feature (89)..(89): Xaa can be any naturally occurring amino acid
  misc_feature (93)..(93): Xaa can be any naturally occurring amino acid
  misc_feature (100)..(100): Xaa can be any naturally occurring amino acid
  misc_feature (103)..(103): Xaa can be any naturally occurring amino acid
  misc_feature (105)..(105): Xaa can be any naturally occurring amino acid
  misc_feature (107)..(107): Xaa can be any naturally occurring amino acid
  misc_feature (112)..(112): Xaa can be any naturally occurring amino acid
MASFTASASTXSIARPALLLKXTVAVSAPVLXLPPMXXRXXGEKXXMETXQGNVSAVXXXVSAXPTXXLTAVMSNPGYXXSLXDRXXNXRGTXLWPFGLXNNXLXNXFLFGXRFSSGTFTFFFGPKN

SEQ ID NO: 27301 - protein, 340 aa, Pinus taeda
MGRQPCCDKVGLKKGPWTAEEDRKLVNFITLHGHGCWREVPKLAGLLRCGKSCRLRWTNYLRPDLKRGLLSESEEKLIIDLHAAIGNRWSRIAAQLPGRTDNEIKNYWNTRIKKKLRQMGIDPVTHKPLTQMQMQSTPAQTLLLQENDTEQKQQEQHNEPDPDQNQSSNGTVETLVSRAREPHDDIEPLQNFNMEDSNFNMEDSMQLFNVCSPTSGISLSGRTEEVDSDDSDQVSKSFGNGSSTHSQYIGRESSGVKAECGLSGWDQMAGVLGDPLSEWNVDLESWAAGLDATAASASAWIQQLPDCQWNDFQGDFEICSSKSCPETLQRLGPFLDDDEL

SEQ ID NO: 27302 - protein, 505 aa, Unknown
  Citrus x paradisi
MDLLLLEKTLLALFAAVVVAITVSKLRGKRFKLPPGPLPVPVFGNWLQVGDDLNHRNLSDLAKKYGDVLLLRMGQRNLVVVSSPDHAKEVLHTQGVEFGSRTRNVVFDIFTGKGQDMVFTVYGEHWRKMRRIMTVPFFTNKVVQQQRFNWEDEAARVVEDVKKDPEAATNGIVLRRRLQLMMYNNMYRIMFDRRFESQDDPLFNRLKALNGERSRLAQSFEYNYGDFIPILRPFLRGYLKICKEVKERRLQLFKDYFVEERKKLASTKSMSNESLKCAIDHILDAQTKGEINEDNVLYIVENINVAAIETTLWSIEWGIAELVNHPEIQKKLRNELDTVLGPGHQITEPDTHKLPYLQAVIKETLRLRMAIPLLVPHMNLHDAKLGGYDVPAESKILVNAWWLANNPAQWKKPEEFRPERFLEEESKVEANGNDFRYLPFGVGRRSCPGIILALPILGITIGRLVQNFELLPPPGQSKIDTAEKGGQFSLHILKHSTIVAKPRSF

SEQ ID NO: 27303 - protein, 555 aa, Methylococcus capsulatus
MGESFAELFEESLAKAEMRAGSIITGTVVDIGTDAVVVNAGLKSEGVIPKWQFLNADGQLEVQVGDQVEVALDMVEDGLGATLLSRDKAKKLKAWEDLEKAFENNETVVGRIVGKVRGGFTVAIGALRAFLPGSLVDVRPVRDTAFLEGRDLEFKVIKIDQKRNNVVLSRRAVVESEFSAEKEALMESLKEGAIVTGVVKNLTDYGAFIDLGGIDGLLHITDMAWKRVRHPSEAVQIGQELQVKVLKYDQEKNRVSLGLKQLGEDPWVNIARRYPAGTRLFGKVSNLTDYGCFVELEEGVEGLVHVSEMDWTNKNVNPAKVVQLGEEVEVMVLDIDEERRRISLGMKQCRQNPWDEFAATHKKGEKIRGTIKSITDFGIFIGLDGNIDGLVHLSDISWSVPGEEAIRQFKKGDELETVILAIDPERERISLGIKQLEQDPFQNFLAAHDKGSIVRGVVKEVDAKGAVITLADNVEGYLRASEIQRDRVEDARALLNVGDEIEAKFIGVDKKTKSISLSIKSKDQDEEAAAIKDYSQQVSGTPTLGDIFKEQMENR

SEQ ID NO: 27304 - protein, 991 aa, Arabidopsis thaliana
MSSIVNRASSASLPNFLAWRALGFRTICSGRLGFAPSVPDSPVSAGTKILESFKEEFEVGSRVVSFETGKIARFANGSVVLGMDETKVLSTVTCAKTDSPRDFLPLTVDYQEKQYAQGLIPNTYMRREGAPKERELLCGRLIDRPIRPLFPTGFYHEVQIMASVLSSDGKQDPDILAANASSAALMLSDVPWGGPIGVIRIGRICGQFVVNPTMDELSSSDLNLIYACTRDKTMMIDVQSREISEKDLAAALRLAHPEAVKYLDPQIRLAEKAGKQKKEYKLSMLSDKTLEKVADLAATRIESVFTDPSYGKFERGEALDNIGKDVRKVFEEEGDQESLSILPKAVDTVRKKVVRSRMISDGFRVDGRHVDEVRPIYCESHYLPALHGSALFSRGDTQVLCTVTLGAPAEAQSLDSLVGPPKKRFMLHYSFPPYCTNEVGKRGGLNRREVGHGTLAEKALLAVLPPEEAFPYTIRINSEVMSSDGSTSMASVCGGSMALMDAGIPLRAHVAGVSVGLITDVDPSSGEIKDYRIVTDILGLEDHLGDMDFKIAGTRDGVTAIQLDIKPAGIPLDIVCESLENAREARLQILDHMERNINSPRGQDGAYSPRLATLKYSNDSLRTLIGPMGVLKRKIEVETGARLSIDNGTLTIVAKNQDVMEKAQEQVDFIIGRELVVGGVYKGTVSSIKEYGAFVEFPGGQQGLLHMSELSHEPVSKVSDVLDIGQCITTMCIETDVRGNIKLSRKALLPKPKRKPASDAGKDPVMKESSTVYIENSSVGEIVASMPSIVTPLQKSRLSVPAVVIRTAVECNEAEKSSPVNDNDKPRRAATSKPDRKPKSTASKLIATQKEEEALESIAPEETSAECGEILKQDGKLKSVSPKNNSTASNLVSFSKAKKSTMKENLSENKAEESASVSTRKLKIGTEMTATVDHVRALGLVLDLGGEIRGMYIFQGDKDKFKKGDTLRVKCTSFNTKGVPVMALVDEEGEE

SEQ ID NO: 27305 - protein, 588 aa, Saccharophagus degradans
MKYDGHQRIKQVEKLSGGDMLIRALADEGVEYLFGYPGGAALHIYDAVFRQKRVQHILVRHEQAATHAADGYARSTGKVGTVLVTSGPGATNAITGIATAYMDSIPMVVISGQVASDKIGEDAFQETDMVGVSRPIVKHSFLVKHAKDIPEIVKKAFYIASTGRPGPVVIDIPKDITNPVDKFEYSYPDKVKIRSYTPAAKGHTGQIKKAVQLLLGARRPIIYAGGGVVQGNASNQLTEIAKLLNFPVTNTLMGLGAFPGTDKQFLGMLGMHGTVEANTAMHHADVIFAVGARFDDRVTNTPSKFCPSAKIIHIDIDPASISKTVTADVPIVGPVEGVLDEMLELVKATKERPDTSAIASWWKQIDEWRDRYSIIDTPRYDTGGMIKPQEVVRMVHEVTGGDAYVCSDVGQHQMFSAQYYQFDKPRRWINSGGLGTMGFGLPAAMGVQIAHRDANVVCVTGEGSIQMCIQELSTCTQYHLPVKIICINNQALGMVRQWQDMQYESRYSESLYEDSLPDFVKLMEAYGHVGMKVTKREELKSKLEECFAMKDKTVFMDIYVDPNEHVYPMQVAPNGSMRDMWLSKSERT

SEQ ID NO: 27306 - protein, 640 aa, Cyanidioschyzon merolae
MATTAGTRRSPSGGALCWAAAPVAAVRFGRWAPPRAHSWTPRRTYPTWSLSLVRSARWCLLRGRRAQVCGAAVMSATEGSSPSSAVRESASSHPAGRAISDAGVIGLAVMGQNFALNLASHGWRVSVYNRTYARTAETVERAQRELAADDTTASGSVTGFADLRSFVLSLKRPRRVFLLVKAGSAVDATVEALAEVLEPGDIIVDGGNEWYENTERRAASVAARGLLYVGMGVSGGEEGARYGPSLMPGGSREAYQQLAPLLEQVAAQVPGSGPCVTYIGPGGSGNYVKMVHNGIEYGDMQLIGEAYDLLRGAVGLDAMAAAEVFASWNAGALQSFLVEITARILRVPDTSSSAASAPALVDQILDRSESKGTGLWTMTEALRRGVAVPTIAAALDGRYLSARKDERERASRVLRGPERLSGTGHASELAAAGASPGAAGAVAETGPDTAPERVAALASGSVRASASTSRSDASAERALIAAIEDALFCSKLCSYAQGLSLLQRASGEQGWSLDLGELARIWKGGCIIRAQLLERIEGAFRRDPSLPNLLLDADLAAEIGRRHESWRRVVGLAASLGVPAPALTASLSYYDTYRQAVLRSSQLVQAQRDCFGSHGYERLDDPGRRWHTRWLSGGDSAEVS

SEQ ID NO: 27307 - protein, 1742 aa, Caldicellulosiruptor saccharolyticus
MVVTFLFILGVVYGVKPWQEARAGSFNYGEALQKAIMFYEFQMSGKLPNWVRNNWRGDSALKDGQDNGLDLTGGWFDAGDHVKFNLPMSYTGTMLSWAAYEYKDAFVKSGQLEHILNQIEWVNDYFVKCHPSKYVYYYQVGDGGKDHAWWGPAEVMQMERPSFKVTQSSPGSAVVAETAASLAAASIVLKDRNPTKAATYLQHAKDLYEFAEVTKSDSGYTAANGYYNSWSGFYDELSWAAVWLYLATNDSTYLTKAESYVQNWPKISGSNIIDYKWAHCWDDVHNGAALLLAKITDKDTYKQIIESHLDYWTTGYNGERIKYTPKGLAWLDQWGSLRYATTTAFLAFVYSDWSGCPTGKKETYRKFGESQIDYALGSTGRSFVVGFGTNPPKRPHHRTAHSSWADSQSIPSYHRHTLYGALVGGPGSDDSYTDDISNYVNNEVACDYNAGFVGALAKMYLLYGGNPIPDFKAIETPTNDEFFVEAGINASGTNFIEIKAIVNNQSGWPARATNKLKFRYFVDLSELIKAGYSPNQLTLSTNYNQGAKVSGPYVWDSSRNIYYILVDFTGTLIYPGGQDKYKKEVQFRIAAPQNVQWDNSNDYSFQDIKGVSSGSVVKTKYIPLYDEDIKVWGEEPGTSGVSPTPTASVTPTPTPTPTATPTPTPTPTVTPTPTVTATPTPTPTPTSTPTVTPTPTPVSTPATSGQIKVLYANKETNSTTNTIRPWLKVVNSGSSSIDLSRVTIRYWYTVDGERAQSAISDWAQIGASNVTFKFVKLSSSVSGADYYLEIGFKSGAGQLQPGKDTGEIQIRFNKDDWSNYNQGNDWSWIQSMTSYGENEKVTAYIDGVLVWGQEPSGTTPAPTSTPTVTVTPTPTPTPTVTPTPTVTATPTPTPTPTSTPVSTPATGGQIKVLYANKETNSTTNTIRPWLKVVNSGSSSIDLSRVTIRYWYTVDGERAQSAISDWAQIGASNVTFKFVKLSSSVSGADYYLEIGFKSGAGQLQPGKDTGEIQIRFNKDDWSNYNQGNDWSWIQSMTSYGENEKVTAYIDGVLVWGQEPSGATPAPTVTPTPTVTPTPTPAPTPTATPTPTPTPTVTPTPTVAPTPTPSSTPSGLGKYGQRFMWLWNKIHDPASGYFNQDGIPYHSVETLICEAPDYGHLTTSEAFSYYVWLEAVYGKLTGDWSKFKTAWDTLEKYMIPSAEDQPMRSYDPNKPATYAGEWETPDKYPSPLEFNVPVGKDPLHNELVSTYGSTLMYGMHWLMDVDNWYGYGKRGDGVSRASFINTFQRGPEESVWETVPHPSWEEFKWGGPNGFLDLFIKDQNYSKQWRYTNAPDADARAIQATYWAKVWAKEQGKFNEISSYVGKAAKMGDYLRYAMFDKYFKPLGCQDKNAAGGTGYDSAHYLLSWYYAWGGALDGAWSWKIGCSHAHFGYQNPMAAWALANDSDMKPKSPNGASDWAKSLKRQIEFYRWLQSAEGAIAGGATNSWNGRYEKYPAGTATFYGMAYEPNPVYRDPGSNTWFGFQAWSMQRVAEYYYVTGDKDAGTLLEKWVSWIKSVVKLNSDGTFAIPSTLDWSGQPDTWNGTYTGNPNLHVKVVDYGTDLGITASLANALLYYSAGTKKYGVFDEEAKNLAKELLDRMWKLYRDEKGLSAPEKRADYKRFFEQEVYIPAGWTGKMPNGDVIKSGVKFIDIRSKYKQDPDWPKLEAAYKSGQVPEFRYHRFWAQCDIAIVNATYEILFGNQ

SEQ ID NO: 27308 - protein, 498 aa, Cyanidioschyzon merolae
MNKALDSDHPNQAVADVGLIGLAVMGQNLVLNMADHGFKVAVFNRTVSKVQEFLETVAKDRETIFGARTIQEFCALIKKPRKVILLVRAGPAVDDFIEKLQPHLDPGDVIVDGGNSYYQDSTRRMKHCAEHGLLFVGCGVSGGEEGARYGPSLMPGGTEAAWPLLRPVLQAIAARADGEPCCDWVGSGGAGHFVKMVHNGIEYGDMQLISEVYDVMRRGLGLSVEECGDIFAAWNETELCSYLIEITANILKYKDDETGKPLVSLILDKAEQKGTGRWTVESSLEHSVPVTLIAEAVFSRMLSSRKAERVRASKVLQGPPAQPPLNEQDRQNMIEKLRLALYASKIVSYAQGYMLMKEAAAAEDWNLNYGGIALMWRGGCIIRSRFLGKIREAYQDEPNLENLLLYRFFRDALLAAQQSWRDAVVFAVSRGITCPAISTALAFYDGYRAETLPASLLQAQRDYFGAHTYERIDKPENQYFHTNWTGTGGTTTSNAYSA

SEQ ID NO: 27309 - protein, 196 aa, Triticum aestivum
QVCTKKQAGTGPEFPGYRRPTRPKLFNAVAVEDLIVKEDRVAGVVTNWALVSMNHDTQSCMDPNVMEAKVVVSSCGHDGPFGATGVKRLQDIGMIQAVPGMKALDMNTAEDAIVRLTREVVPGMIVTGMEVAEIDGAPRMGPTFGAMMISGQKAAHLALKALGRPNGIDGTLKNVTPALHPEMILAATNNGDIVDA

SEQ ID NO: 27310 - protein, 112 aa, Shewanella oneidensis
MKLITAIIKPFKIDDVREALTQLGIHGMTVTEVRGFGRQKGHTELYRGAEYAVDFLPKMKLEIAIHSELEEAVIEAIIQAAHTGKVGDGKIFVTPLEQVIRVRTAEEGVDAI

SEQ ID NO: 27311 - protein, 309 aa, Coprinopsis cinerea
MPRAEVGTPKYIANKMKSKGLQRLRWYCQVCQKQCRDENGFKCHVQSESHLRQMLVVGENAGSHIASFSHQFQSEFVALLSRRFGTKRVLANRVYQEYISDKHHLHMNATRWVTLTEFVKHLGRSGIARVDETEKGWFIAWIDNSPQALAKQEASMKKERATMSDEQRERQLIAEQIERAKEESGDAGASRDSPPEERELKRDEGQEKVVLSLSMAKPAAAAAPAASNGLKLNPLKTNPLKVNPLKANPLKRPNPLKSGGSSSKEKEKEKESPEPVNEKKRSAPMSAAEALILEEQERKRRRMERDNTA

SEQ ID NO: 27312 - protein, 168 aa, Citrus jambhiri
LGSQIKVSTAIELGALDTSSPPSAGSFKQDYRPILDPLIAFLNENNSPLLVNLYPYFAIVGDRQISLDYALFRSQQPVVLDPPLSYQNLFDAQLDATYAALEKAGGGSLDIVISESGWPTAGGDGALTNVDNAMTYNNNLIQHVKQGSPKKPRPIETYIFTMFDEKDK

SEQ ID NO: 27313 - protein, 195 aa, Unknown
  Burkholderia sp. 383
MRVAEVVRNTSETQIRVKLNLDGTGQQKLATGVPFLDHMLDQIARHGLVDLEVEAHGDTHIDDHHTVEDVGITLGQAVAKAIGDRKGIRRYGHSYVPLDEALSRVVIDFSGRPGLEFHVPFTRARIGTFDVDLSIEFFRGFVNHAGVTLHIDNLRGINAHHQLETVFKAFGRALRAAVELDERAAGQIPSTKGSL

SEQ ID NO: 27314 - protein, 125 aa, Glycine max
  misc_feature (58)..(58): Xaa can be any naturally occurring amino acid
  misc_feature (70)..(70): Xaa can be any naturally occurring amino acid
  misc_feature (93)..(93): Xaa can be any naturally occurring amino acid
YTQFKNTPYPNSPFCRGVLESNIKISDVGMNNKGVDEYPFCVHLVIWDKDNVSIEVLXAVHIACNMYMDXLAGKGCLNYIVRVHPYNVLMINXMLSYSSANMLQTVMKGAFRNAQDAYTTNAVKQ

SEQ ID NO: 27315 - protein, 251 aa, Vitis pseudoreticulata
MAEEKCFIAKDVTELIGKTPLVYLNNVVDGCVARIAGKLEMMEPCSSVKDRIGYSMITDAEEKGLITPGESVLIEPTSGNTGIGLAFMAAAKGYKLIITMPASMSLERRIILRAFGAELVLTDPAKGMKGAVQKAEEILAKTPNSYILQQFENPANPKIHYETTGPEIWRGTGGKVDAFVSGIGTGGTITGAGKFLKEQNSDIKLYGVEPVESAVLSGGKPGPHKIQGIGAGFIPGVLDVNLLDEGCSSFK

SEQ ID NO: 27316 - protein, 603 aa, Ruminococcus gnavus
MLEYSELYPIQNEYRMMQSLDGMWKFQFDPEEIGKKSGWENGLPAPVSMPVPSSFADFFTDHKERDYCGDFWYETEFYLPAEWRNKKIWLRFGSITHRGTVYCNGMEITSHEGGFLPVLADISTVAKPGQVNQVVVKINNELNETSLPCGATKILNNGRKLAKPYFDFFNYSGLQRSVWVIALPEESVKDYSVDYELCGTDALVKYEVVTTGEHPVIVRLLDAEGELVAETEGKEGILQVANARLWEVRNAYLYQIVILITDGNGVLDEYREKIGIRTVRIEGTKILLNDRPVYLKGFGKHEDFPILGRGFHWGIVKRDFECLKWTNANCFRTSHYPYAEEWYQFADEEGFLIIDEVPAVGMMRSTRNFVAAGSGNYTYFFEALTVPELLKSHIADTEEMITRDKNHPSVIAWSLFNEPETITDYAYEYFKEVFAAAETYDFQSRPMTGAFEKNSKPELCKCYPLCDFICLNRYYGWYISGGPEIEEAEELFRDEMDRWKAKELNVPFVFTEFGTDTMAGLHKLPSIMWSEEYQKEYLEMNFRVFDSYEFVQGELAWNFADFQTTEGIMRVDGNHKGVFTRDRQPKAAAVVFKDRWEKKNELF

SEQ ID NO: 27317 - protein, 76 aa, Zea mays
SIYCRLVPDPKITIYYVSMNRKGVDEFPYCVHLVSWEKENVSCDSLETALIDCNNYMTNSAGNDAFHLHLPVHPLN

SEQ ID NO: 27318 - protein, 379 aa, Staphylococcus aureus
MAKRDYYEVLGISKDASKDEIKKAYRKLSKKYHPDINKEEGADEKFKEISEAYEVLSDDNKRASYDQFGHDGPQGFGGQGFNGSDFGGFSGFGGGGFEDIFSSFFGGGRQRDPNAPQKGDDLQYTMTLTFEEAVFGTTKEISIRKDVTCETCHGDGAKPGTSKKTCSYCNGAGHVAVEQNTILGRVRTEQVCPKCNGSGQEFEEACPTCHGKGTENKTVKLEVKVPEGVDNEQQIRLAGEGSPGVNGGPAGDLYVVFRVKPSETFKRDGDDIYYKLNVSFPQAALGDEIKIPTLNNEVMLTIPAGTQTGKQFRLKEKGIKNVHGYGYGDLYVDIKVVTPTKLTDRQKELMKEFAQLNGEEINDQPSNFKDRAKRFFKGE

SEQ ID NO: 27319 - protein, 710 aa, Xanthomonas axonopodis
MRRPASAAYANPSRIRQGRPFPRGAVFDGKGTNFALFSAHATRVELCLFDEQGNETRVDLPEYTNEIWHGYLPDAKPGQRYGYRVHGPYAPTEGHRFNHNKLLLDPYARELDGDLIWSDELYGYTVGHPDGDLSFDERDSAPFMPKCVVVEDTYDWGDDTRLLKPWNETVIYETHVRGYTMRNPQVPEAVRGTFAGLAQPQVLQYIKDLGITAVELLPVHAYLDDQHLLDKGLRNYWGYNTIGFFALKSRYLSSGHRDEFRDMVKAMHKQGLEVILDVVYNHTAEGSELGPTLSFKGIDNASYYRLADDKRYYINDTGTGNTLNLSNSRVIQFVNDSLRYWAGEMHVDGFRFDLATILGREPSGFDQRGGFLDACNQDPLLSEVKLIAEPWDCGPGGYQVGHFPPGWSEWNDKFRDNAREFWKGEDGKLAEFATRFTGSADLFDRRGRRPWASVNFITAHDGFTLRDLVSYNEKHNIDNGEDNRDGSSNDGSCNYGEEGDTDNAEVLQIRERQMKNLLATLLLSQGTPMMLSGDERAQTQGGNNNTYCQDNEITWLDWENDPTDGRLTEFVKALTRLRKRYPILSRGRFLNGQYNEEAGLRDLTWLNPGGIEMDDAHWTDPAARSVGLLLEGKAQTSGVKELANDDTLLIVINAYHEGVTFTLPSSDEPVHWKLVLSTDEALEVDMMPAGASEFLAPPRSVSVFECKSDQ

SEQ ID NO: 27320 - protein, 708 aa, Unknown
  Photobacterium sp. SKA34
MNPIVKTFQYGNHTVTLETGVMARQATAAVMVSMDDTSVFVSVVGKKTAVEGQDFFPLTVNYQERTYAAGKIPGGFFKREGRPSEGETLTARLIDRPIRPLFPDDFKNEVQVIATVVSVNPAVNPDIVTMIGTSAALTISGIPFNGPIGAARVGYINDQFVLNPSNVELEESRLDLVVAGTKDAVLMVESEADRLSEEQMLQAVVFGHDQQQVAINAINEFAAEVATPAWDWVAPQENTALKNKIAELAETKLVEAYQITEKMARYDRIHEIAGEVNDAILAEDAEANTKEIHTIFHDLEKTVVRGRIIAGNPRIDGREKDMVRALDVRTGVLPRTHGSSLFTRGETQALVTATLGTQRDAQIIDGLTGEKKDHFLLHYNFPPYCVGETGFVGSPKRREIGHGKLAKRGIAAVMPSVDEFPYTVRVVSEITESNGSSSMASVCGTSLALMDAGVPIKASVAGIAMGLVKEGDDFVVLSDILGDEDHLGDMDFKVAGTDDGITALQMDIKIEGITKEIMQIALNQAKGARKHILSVMDNAINTPREDISQFAPRIHTMKINPEKIKDVIGKGGAVIRALTEETGTTIEIEDDGTVKIAATEGTAAKEAIRRIEEITADVEVGRIYTGKVMRIVDFGAFVSVIGTKEGLVHISQISQDRVEKVSDYLQMGQEVQVKVLEIDRQGRIRLSMKEAVETPAAEAPAQNEQPQG

SEQ ID NO: 27321 - protein, 322 aa, Kineococcus radiotolerans
MAGVHVAVLGSGAWGTAVAGLLAANASSVGLWCRRPELAERIRVSGRNEQYLPGIDLPARVHAGSRVEDVVEGAELVVLAVPLQRLRSLLLRWREVLPAVPVVNLAKGVETSTGLFGSEVVADVLDGRPVLALSGPNLALEIARGQPAATVVACVDAEVAGRVATWCSTPDFHAHPLTDVVGVDVAGAVKNVVALAVGMVEGAGLGANARAAVTTLGLTETAELGRRLGARLETFLGLAGAGDLVATSTSTLSRNHRVGVALGEGLPLAEALVRAGGTAEGVATAPALLRRDPDLPFVRDVVAVLDGQRSPVEAVTRLLTVA

SEQ ID NO: 27322 - protein, 274 aa, Oryza sativa
MAIAAITGGGRRPPCRRGPAAVAPPARFSCRCGTHPVPRRNVLSTMLSTSTVILFGSKQITLAEITGATFREYIDTFDGYSFLYPKSWIQVRGAGADIFFRDPFVLDENMSVEISSPSSSKYVTVEDLGPPEKAAERVLQQYLTEFMSTRLGVRRTSNILSASSKVADDGKLYYEVEVNIKSFASNNELAVMPQDRVQRLEWDRRYLSVLGVENKRLYELRLQSPEQVFKEEEGDLRRVMDSFRVNKTLSEARCGDLGIPNNGSHQFRVRARFH

SEQ ID NO: 27323 - protein, 87 aa, Arabidopsis thaliana
ANEDGYHQDAFLAASMLSSAAEVTSPGGATMIAQFTGLTQCPGFPVTRKTTTDLTFIPSNGGRVRCMKVWPPIAKKKLETLYYRRDL

SEQ ID NO: 27324 - protein, 650 aa, Methylobacillus flagellatus
MYEQVSHSLLNDILIGLDPKVGCEDLKHFYIRLGANFYAIHSLFHQLYGDRQDFRLQMHKLVAVMAKQYVSRPQELRHRDLAREKDHNWFLSQKLAGYALYCQEFAQSLKGMHEKLDYLQELGINLIHIMPILDGPKGRNDGGYAVRDFRKIDEKYGTLEDLDTLSAELRSRDMLLVLDVVVNHTSDEHEWALKAQQGNKKYQEYYYTYPDRKIPDLFEQTMPEVFPDTAPGNFTWNEKMGRWVMTVFNNFQWDLNYRNPSVFIEMIDIILFWANHGADVIRLDAVAFLWKKIGSPCQNEREAHLILQLMKDCCQVTAPGTLFIAEAIVAPLEIIKYFGEDAVNAKECEIAYNATYMALLWDAVATKKTLLLNRGLRSLPTKLDGATWLNYVRCHDDIGLGFDDNDIRASGYDPQAHRRFLVDYYTGAYQGSTATGVAFGVNPKTGDARISGSLASLAGLETALLRNDAQAIDTSIRTIILLHSMIASFGGIPLIYYGDSIGTLNDNTYLDDENKHHDSRWVHRPSLDWNKAARRHEPGTVENRIFTAIQRILAVRKQIPAFADLNNREIFETSNPHLFTFLRFTSQGMHSRVLVIANFDASPQYMNLRELDSVNLFRHVEVKDLYSGETLSTKHGTLEIPPLGFYWLQL

SEQ ID NO: 27325 - protein, 296 aa, Geobacillus kaustophilus
MADQVTIGLIQASHNVHGDEPVEVHKEKAIEKHVKLVKEAKDRGAQIICLQEIFYGPYFCAEQNTKWYEAAEEIPNGPTTKMFQEIAKQLGVVIVLPIYEREGIATYYNTAAVIDADGTYLGKYRKQHIPHVGVGNEGCGFWEKFYFKPGNLGYSVFDTAFAKIGVYICYDRHFPEGARILGLKGAEIVFNPSATVAGLSEYLWKLEQPAHAVANGYYVAAINRVGYEAPWNMGEFYGQSYLVDPRGNFVAMGSRDQDEVVIGVMNKKMIREVRDIWQFYRDRRPETYSEMTALLP

SEQ ID NO: 27326 - protein, 437 aa, Escherichia coli
MSKQQIGVVGMAVMGRNLALNIESRGYTVSIFNRSREKTEEVIAENPGKKLVPYYTVKEFVESLETPRRILLMVKAGAGTDAAIDSLKPYLDKGDIIIDGGNTFFQDTIRRNRELSAEGFNFIGTGVSGGEEGALKGPSIMPGGQKEAYELVAPILTKIAAVAEDGEPCVTYIGADGAGHYVKMVHNGIEYGDMQLIAEAYSLLKGGLNLSNEELAQTFTEWNNGELSSYLIDITKDIFTKKDEDGNYLVDVILDEAANKGTGKWTSQSALDLGEPLSLITESVFARYISSLKDQRVAASKVLSGPQAQSAGDKAEFIEKVRRALYLGKIVSYAQGFSQLRAASEEYNWDLNYGEIAKIFRAGCIIRAQFLQKITDAYAEDPQIANLLLAPYFKQIADDYQQALRDVVAYAVQNGIPVPTFAAAVAYYDSYRAAVLP

SEQ ID NO: 27327 - protein, 369 aa, Clostridium difficile
MDFKSLGISENTINILKKSGITTPTPIQKESIKLIKEGKDVIAEAQTGTGKTLAFLLPIFENISLDINDIQVLILSPTRELAIQITEEAMKLKESKDVSILAAYGGKDIGSQIKKLKGNIHMIIATPGRLLDHLNRKTIDLSKLKTFVLDEADQMLLMGFKNEVEAILKETSNKKQTLCFSATINSQVKKLAYRYTKNPVVVSIQKEEITLNNIKQEVVETTDRKKLDALCKVLDEDNPFMAIIFCRTKRRVDNLEEALAIRGYNCQKLHSDIAQSKRERIMKSFRNLDIQYLIATDVASRGLDISGVSHIYNYDLPETPEDYIHRIGRTGRAGEEGYTCAFIDPKNERMLSEIETAIESKISRRIIEL

SEQ ID NO: 27328 - protein, 112 aa, Glycine max
  misc_feature (64)..(64): Xaa can be any naturally occurring amino acid
  misc_feature (111)..(111): Xaa can be any naturally occurring amino acid
MGSEASGGAAAIDLLRSAAPFLPDADLLLTPGTGLVLVDLVNGFCTVGAGNLAPVTPNKQIEKXVEESTRLAKVFCQRNWPVFAFLDTHHPDKPEPPFPPHCIIGSGEENXV

SEQ ID NO: 27329 - protein, 137 aa, Synechococcus elongatus
MRLLHTMLRVGDLERSLQFYCEILGMQLLRRKDYPGGEFTLAFVGYGEEADHTVLELTYNWGKEQYELGDAYGHIAIGVDDIYATCEAIRARGGKISREPGPMKHGSTVIAFVEDPDGYKVELIQTGTSGASAQPAA

SEQ ID NO: 27330 - protein, 197 aa, Yarrowia lipolytica
MSLLDRYNSQLVDEGDAEDQEFLDLLDDDEAFQGYREQRIAELSRQMKEAKDGAQSGHGSVQTLESDKDVLEATTSADRCVIHFFHPDFTRCKIMDSKLEQLAARHLGTRFVRVDASKAPFLATKLGLKALPVVVCYIKGQEATRVVGFERLGGTDNFQLSALENLLYTYGIIQRVGTSGMRRAEKKMEEEDEDWSD

SEQ ID NO: 27331 - protein, 727 aa, Pseudomonas syringae
MNTKSTPAADESSASHDSSASTPTRIREGLPFPLGASWDGLGVNFALFSANATKVELCLFDSTGEVELERIELPEYTDEIYHGYLPDAHPGLIYGYRVYGPYDPKNGHRFNHNKLLIDPYAKQLVGELKWSEALFGYTIGHADGDLSFDERDSAPFVPKSKVIDEAYTWGRDQRVGTPWDKTIFYETHVRGITMRHPEVAEELRGTFAGLGSAPVVDHIRKLGVTSVELLPIHAFVNDQHLLQKGMTNYWGYNSIAFFAPDPRYLASGKIAEFKEMVAHLHHAGLEVILDVVYNHTAEGNELGPTLSMRGIDNASYYRLMPDDKRYYINDSGTGNTLDLSHPCVLQMVTDSLRYWASEMHVDGFRFDLATILGRYHDGFDERHSFLVACRQDPVLRQVKLVAEPWDCGPGGYQVGGFPPGWMEWNDKFRDTVRAFWKGDEGQLADFAARMTASGNMFNQRGRRPQASVNFITAHDGFTLHDLVSYNDKHNEANDENNQDGSNNNVSWNHGVEGPTEDPEINTLRLRQMRNFFATLLLAQGTPMIVAGDEFARTQHGNNNAYCQDSEIGWINWDLDEDGEALLKFVTRVIKLRQSYPILRRSRFLVGDYNEEIGVKDVTWLAPSGEEMSVEQWHDANGRCLGMLMDGRAQETGIRRPGADATLLLVVNSHHDGVNFTLPQVPEGTHYECLIDTNQDDARSKEQFAFGSHYTVTPRSLLLFEVKREDQQ

SEQ ID NO: 27332 - protein, 959 aa, Yersinia pestis
MTQNLSQLEHNDAFIQRHIGSSVEQQQQMLAAVGASSLSTLIQQIVPADIQLPGPPPVGEAATEHQALAELKGIASQNQCYKSYIGMGYSPVLTPPVILRNMLENPGWYTAYTPYQPEVSQGRLEALLNFQQLTQDLTGLDLASASLLDEATAAAESMALAKRASKLKDANRFFVADDVHPQTLDVVLTRAETFGFDVIVDRAEKVLELDGIFGVLLQQVGTTGELHDYSALLAELKKRKIITSVAADIMALVLLTAPGAQGADVVFGSAQRFGVPMGYGGPHAAFFACRDEFKRSMPGRIIGVSRDAAGNTALRMAMQTREQHIRREKANSNICTSQVLLANIASLYAVYHGPQGLQRIAGRIHRMTDILAAGLQHAGLTLRFKHWFDTLTVEVKDKAAVLARALSFGINLRTDIHGAVGITLNETTSREDIQTLFALFVGDNHGLDIDQLDAAVSQHSQSIQDSMLRRDPILTHPVFNRYHSETEMMRYMHRLERKDLALNQAMIPLGSCTMKLNAAAEMIPITWPEFAELHPFCPPEQAAGYQQMIGQLSQWLVQLTGYDAVCMQPNSGAQGEYAGLLAIRRYHESRNQANRHICLIPSSAHGTNPASAQMAGMSVVVVACDKQGNIDLHDLRQKAEHAGDELSCIMVTYPSTHGVYEETIREVCQIVHQFGGQVYLDGANMNAQVGITTPGYIGADVSHLNLHKTFCIPHGGGGPGMGPIGVKAHLAPFVPGHSVVQIDGMTTQQGAVSAAPFGSASILPISWMYIRMMGADGLKQASQVAILNANYIATRLKNAYPVLYTGHDGRVAHECILDIRPLKEATGISEMDIAKRLIDFGFHAPTMSFPVAGTLMVEPTESESKVELDRFIDAMLAIRAEIEKVAQGEWPLEDNPLVNAPHTQAELVGEWTHPYSRELAVFPVAGVLENKYWPTVKRLDDVYGDRNLFCSCVPISDYE

SEQ ID NO: 27333 - protein, 495 aa, Zea mays
  misc_feature (289)..(289): Xaa can be any naturally occurring amino acid
METVFKWRARTGGGVSLIHLLVRCFAVAAAILLLADGRHAHAVDHPAPVEVQTGSCSEVADEQQWRMVKTRGNQFVVGDDHDDRPFYVNGFNTYWLMILAVDPSTRGKVTEVFQQAVAAGLTVCRTWAFNDGGWRALQKSPSVYDEDVFKALDFVVSEARKYRIRLILSLINNWDSYGGKAQYVKWAGDDAAADGGRLNITASVDDDFFSDQTVKVYFKNHVKNMLTRVNTYTSVMYKDDPTIFAWELMNEPRCTSDPAGNKLQEWIQEMAFHVKSIDPDHLLEVGGLXAEGFYGPSSPSRLPANPNAYAGQVGTDFIRNHRVLGVDFASVHIYPDTWMPGATLEARLWFVDSWMEAHIADADGTLGMPVVFTEFGASTTKARSGCFNATTRDQFIQAVYARLLNSTRRGGAGAGALLWQMLPLGTDYMDDGYGVVLPRAAATARIISAHSRDLAIFNSRCAWSCRWGCRRRGHKSEDPDVDDDLPLVEDKQREA

SEQ ID NO: 27334 - protein, 187 aa, Schizosaccharomyces pombe
MQIAIIAAGCFWGVQEVYLRKFIPAAAILKTSVGYTGGITADPTYKEVCTNTTNHAEALKIEFDEKLTSYDKIIEFFFAMHDPTTSNQQGNDIGTQYRSAIFTTNPEQATIAKRVMNEVQAKHYPNKKIVTQILPAGKWWDAEDYHQLYLEKNPDGYRCSSRMNIKCQVNQKVLLTHSIRFFALECF

SEQ ID NO: 27335 - protein, 408 aa, Oryza sativa
MASVRGERTALPARAACGLRAAAGTPAPIWVPVGGRAVPWAAATAVEVGCCPPLCPLPCPSSCQLLKLPVGGDVAGDGAVDADAQGLNLYLRRTCRIFRRLRLRLRPGCCQLRCRQSGRPSCCCSGLSRCSPALFCCGELGVLLTPSARGDRTPRPSVGHGAPPGGCCVERGKGKGKEEQPESVALIPDVRISMVTLIEKRMALEMGQFSVFLFGPKQITLAETTGGTFREYIDTFDGYSFLYPKSWIQVRGAGADIFFRDPFFLDENMSVEISSPSSSKYMTVEDLGPPEKAAERVLQQYLTEFMSTRLGVRRTSNILSASSKVADDGKLYYEVEVNIKSFASNNELAVMPQDRVQRLEWDRRYLSVLGVENKRLYELRLQSPEKVFKEEEGDLRRVMDSFRVNKTA

SEQ ID NO: 27336 - protein, 358 aa, Arabidopsis thaliana
MAGAVSLWRREAVFLTAMLAGETSIVGLSTLFKVATSKGLNIYPFLSYSYLLASLLLLPSLFFTNRSRSLPPLSASILSKIGLLGFLGSMYVITGGIGIEYSNPTLASAIGNIVPALTFILAVIFRMEKVSFKERSSVAKVMGTILSLIGAFVVIFYHGPRVFVASSPPYLNFRQLSPPLSSSKSDWLIGGAILTIQGIFVSVSFILQAHIMREYPEAFTVSILYILCISIVTSMIGLVVEKNNPSIWIIHFDITLFTIVTTGIITSVYYVIHSWAIRHKGPLYLAIFKPLSILIAVVMGTIFLNDSLYLGCLIGGILITLGFYAVMWGKSNEEKDKLLSFSGKEKTPLLLSGKNEQV

SEQ ID NO: 27337 - protein, 228 aa, Zea mays
MAGASLLSPSCTLLRLIPSASHICCSSHFKRFDRVRRFAPAAMATSSGPKEAPANNPGLQTEVDPATKGYFLQQTMLRVKDPKVSLDFYSRVMGMSLLKRLDFEEMKFSLYFLGYEDVTLAPDDHIKRTEWTFRQKATLELTHNWGTENDPEFKGYHNGNSDPRGFGHIGVTVDDVHKACERFERLGVEFVKKPDDGKIKGIAFIKDPDGYWIEIFDQTIGTVTSSAS

SEQ ID NO: 27338 - protein, 441 aa, Unknown
  Nocardioides sp. JS614
MSAASAARRVDRELEVVVLESGAHAAYGLCGLPYFLSDVVTEVDSLRAYPPTFFQEQRDINLRFGAEVVRIDPERQLVNFRSEGQSEHLHYDKLILTAGATPSLPPIPGLDDDHVFTIRNVAESVRLRCLLDAGHIGHATVVGGGYIGLEVVESFAERGVSVTLIEALPGLMANLDPEFSRRVEEEVRLHAEVRLSSGLVSLVRTDEGLTLSLADGDTIETDVVVVATGVRPASGLGSSIGANTGPHGALLVDEQMRTSVPNVFAAGDCIAPNHIVTGRPTFIPLGPAANKTGRVAGTVAAGGTACFSGVAGTAIVKVFGLGIGRTGLTLAEALSAGYDAQATDAVGRSRAKYFPGSAPIDVRLVHNSDGRLLGAQFVGVGDEVAKRVDVAAVALHAGLSVEDLADLDLSYAPPFAPVYEPILLAANSAVASLKPMEDLAH

SEQ ID NO: 27339 - protein, 295 aa, Xylella fastidiosa
MTTHLLPVALIQERNHGTAEANLSIIEARVAEASVQGAQLVLLHELHNSAYFCQHESVNEFDLAEPIPGPSIERLSALAKQHRVVIIGSLFEKRAAGLYHNTAVVLEKDGRLVGKYRKMHIPDDPGFYEKFYFTPGDIGFKPIDTSVGRLGVLVCWDQWYPEAARLMALAGAELLLYPTAIGWDPNDEHDEQTLQRDAWLLSHRGHAIANSLPVLSCNRTGHEPSPLGTSGIQFWGNSHVLGPQGEFLAEANSNGPEILTCEINLQRSEHVRRIWPFLRDRRIDAYGDLLKRYID

SEQ ID NO: 27340 - protein, 130 aa, Methylococcus capsulatus
MRILHTMLRVGDLQKSLWFYTEVLGMRLLRQMEFPDGEFTLAFVGYGDEAHDAVIELTYNWGVSKYELGTGFGHIALGVDDIHAAVERIRALGGEIVREPGPMKHGTTVIAFVADPDGYRIELIEHKPAG

SEQ ID NO: 27341 - protein, 323 aa, Streptomyces avermitilis
MSDVRNVIIIGSGPAGYTAALYTARASLKPLVFEGAVTAGGALMNTTEVENFPGFQDGIMGPELMDNMRAQAERFGAELVPDDVVAVDLTGEIKTVTDTAGTVHQAKAVIVTTGSQHRKLALPNEDALSGRGVSWCATCDGFFFKGQDIAVIGGGDTAMEEATFLSRFAKSVTIVHRRDTLRASKAMQERAFADPKIKFVWDSEVAEIKGDPKLAGLSLRNLKTGEISELPVTGLFIAIGHDPRTELFKGQLDLDEEGYLKVDAPSTRTNLSGVFGAGDVVDHTYRQAITAAGTGCSAALDAERFLSALAAAEDAAEPEKTTV

SEQ ID NO: 27342 - protein, 439 aa, Pichia angusta
MSSASEFLDKGVDLVKKAIEADSTSKYDEAYRLYYNGLDYLMLALKYEKNPKSKETIRSKFTEYLSRAEQLKEYLDKKQQQDQTGEASATSGSVKAKKTSGGEDDDNDSDTKKLRGALASSILSERPNVQWSDIAGLELAKEALKEAVILPVKFPHLFRGKRKPVSGILLYGPPGTGKSYLAKAVATEANSTFFSVSSSDLVSKWMGESERLVKQLFTMAREQKPAIIFIDEVDALCGPRGEGESEASRRIKTELLVQMNGVGNDSDGVLVLGATNIPWQLDAAIRRRFERRIYIPLPDQEARVEMFKLNIGDTPCSLTTQDYHTLAQMTDGYSGHDVSVVVKDALMQPIRKIQMATHFKKVVSTDEEGRELVQYTPCSPGDSEAIEMSWLDLDGEQLKEPELGIKDFIKAIKTNKPTVNQKDLEKFIEFTNDFGSEGN

SEQ ID NO: 27343 - protein, 322 aa, Unknown
  Nocardioides sp. JS614
MNLPDLPRLPLVLAPTPLVPAPRLSEILGLDVWFKRDDLTGRGLGGNKVRPLEYLLGDAKTKGCDALVTGAGPQSNWAMLAALTAHGAGIAPHLVFYGDPQHPTGNLLLAQLAGADIHYTGELDRGSVDPALFKAADELTDAGHLPYVVPRGGATPIGCLGYVRATAELLAQLAETGLSPASIWLATGSGGTQAGLVAGAQWSGWEIDVIGITTSRSPEEAASRVRDLASATLDLIGVGDTSIAAPQVRGGYLGEGYGKASPAGAAAAQLVAQTEGVFLDPAFGAKAMAALIDAARDGTVEGPVVFLVTGGAPTLFTPGAQL

SEQ ID NO: 27344 - protein, 1013 aa, Oryza sativa
  misc_feature (932)..(932): Xaa can be any naturally occurring amino acid
MALAGSMAAAAATSTLLLLLLLLLLATATHGAAADTVSSPASPEAAALLNLSAALGDPSGYLSTHWTHDTAFCSWPRLSCDADGSRVLSLDLSGLNLSGPIPAAALSSLSHLQSLNLSNNILNSTFPEGLIASLKNCRNSARGNNNLTGALPAALPNLTNLVHLHLGGNFFFGSIPRSYGQWSRIKYLALSGNELTGEIPPELGNLTTLRELYLGYFNSFTGGIPPELGRLKELVRLDMANCGISGVVPPEVANLTSLDTLFLQINALSGRLPPEIGAMGALKSLDLSNNLFVGEIPASFASLKNLTLLNLFRNRLAGEIPEFVGDLPNLEVLQLWENNFTGGVPAQLGVAATRLRIVDVSTNRLTGVLPTELCAGKRLETFIALGNSLFGSIPDGLAGCPSLTRLRLGENYLNGTIPAKMFTLQNLTQIELHDNLLSGELRLDAGVVSPSIGELSLYNNRLSGPGNSDEGGLVGLQKLLVAGNRLSGERPREIGKLQQLSKADLSGNLISEEIPPAIAGCRLLTFLDLSGNRLSGRIPPALAGLRILNYLNLSHNALDGEIPPAIAGMQSLTAVDFSDNNLSGEVPATGQFAYFNATSFAGNPGLCGAFLSPCRSHGVATTSTFGSLSSASKLLLVLGLLALSIVFAGAAVLKARSLKRSAEARAWRLTAFQRLDFAVDDVLDCLKEENVIGKGGSGIVYKGAMPGGAVVAVKRLPAMGRSGAAHDDYGFSAEIQTLGRIRHRHIVRLLGFAANRETNLLVYEYMPNGSLGEVLHGKKGGHLQWATRYKIAVEAAKGLCYLHHDCSPPILHRDVKSNNILLDAEFEAHVADFGLAKFLRGNAGGSECMSAIAGSYGYIAPEYAYTLKVDEKSDVYSFGVVLLELIAGRKPVGEFGDGVDIVHWVRMVTGSSKEGVTKIADPRLSTVPLHEXLTHVFYVAMLCVAEQSVERPTMREVVQILTDLPGTAAAAAAAATAMDAPSHGSGKEQDRSAEMQQQDGSRESPPQQDLLSI

SEQ ID NO: 27345 - protein, 510 aa, Plantago major
MENSNRGVGAKTIITTTPPPEEAAPIRNIFLVAAIAAGVQFGWALQLSLLTPYVQLLGIPHKWASYIWLCGPISGMIVQPVVGYFSDNCTSRFGRRRPFIAAGAGLVGVAVVLIGFAADLGHAGGDSLGDGLKPRAIGVFVFGFWILDVANNMLQGPCRALLADLSGGNTKKMANANSFFSFFMAVGNVLGYAAGSYSRMYKVFPFSKTKACDIYCANLKSCFIISITLLITLTTLALSIVREKRHVAEEQVTAAKKGFKIPVFPELFGALKDLPRPMWVLLLVTALNWIAWFGFLLFDTDWMGREVYGETQQHKAPELAVIYNKGVSAGALGLMLNSIVLGFASLGVQYMARALGGVKRLWGVVNFILAICLCMTIVITKVASHHRPYSNGVLQTPESSVKIGALVVFSALGIPLAITFSVPFALASIYSTTTGSGQGLSLGVLNLAIVIPQMIVSVASGPWDAMFGGGNLPAFVVGAVAAAASGIFAFTMLPSPPAESIKNLSVAGGH

SEQ ID NO: 27346 - protein, 491 aa, Methanothermobacter thermautotrophicus
MKYRCKVCDYIYDPEVGDPRSGIEPGTPFEELPDDWLCPVCNVGKDQFEPLRGEIKRVRPEDIDMFCYQCSQTVRGRACTIRGVCGKEPTVARLQDNLLFAIKGISAYLYHARELGYTDEEVDAFLERGFYSTLTNVNFDAGEFIDLALEAGEMNIRTMKLLKKAHIDTYGEPEPTEVRVGALEGPAIIATGHSLRALEELLKQTEGTGINVYTHSELLPAHGYPGLRKYPHLAGQLGGPWFDQKDTFSRYTAAILGTSNCVLLPRDDYRDRMFTCGVAALPGVEHLEGYDFSPLIDKALELPPLSEEDATTLTTGFGLSTILSLADKIRELVEDGKIRRFFLVGGCDSPLPRAKYYTEFVRKLPEDTVVLTLACGKYRFNSMDLGDIEGVPRLIDLGQCNDAIVAVELVEALSNLFQMDINELPLSIILSWMEQKAAAILWSLLSLDLKGMYIGPILPGWANEDIVKFLVDNYDLTPIGDPEEDIRKILG

SEQ ID NO: 27347 - protein, 266 aa, Kineococcus radiotolerans
MKIAGLQHPGTPGDVEENLAALEAAATRAAAEGVRLLVTSEMFLTGYNIGDRVAELAREPLEERVADVARRTGVALAVGLPLPGKSGVTNSVLLLDETGRRLARYDKTHLFGALDRSLFVPGEHPTVTADLDGVRLAFLVCYDVEFPETVRAAALAGADLLVVPTAQMEPFAFVAEHLVRVRAWENQVYLAYVNHSGAEGDLRYVGRSSISAPSGDVLAMADVDGEALLVADVDVEVVRAARRDNPYLDDLRAEFRLPPALPEVTP

SEQ ID NO: 27348 - protein, 576 aa, Glycine max
  misc_feature (215)..(215): Xaa can be any naturally occurring amino acid
MADGSSSNTKRNSLILHHPTNLKGGWNAAIFIIFVEFAERFAYQGLASNLIQYLTNVLNEPITQAAKDVNTWVGASSLFPLLGGFIADSYLGRFNTILLSSVIYFAGMVFLTLSVSALKHKFLFFLALYVLAIGDGGHKPCVQTFAADQFDEDTPEEKDAKSSFFNWWYLGIVAGSTASVFVVIYLHDNVGWGVGLGVLAGVLALALALFLVGNXRYRKEGPAGSPFTRLAQVFVAASRKWRVQATHGHHNYCYDEDEEHHEPHNHLHVQPKIHTLLHTHQYRFLDKAAIIDEIDAKTKTRDPWRLCSVTQVEEVKLVLRLIPIWLSCLMFTVVQAQVHTFFIKQGATMVRSIGPHFQVPPASLQGLVGVTILFAVPFYDRVFVPLARKITGKPTGITVLQRIGVGLFLSILNMVVSALVEAKRVGVAKESGLIDDPKAVLPISIWWLLPQYMITGISDAFTIVGLQELFYDQMPEALRSLGAAAYISIVGVGSFVGNIVIVVVEGVTSRAGEKWLGNNLNRAHLDYFYWVLAGLSAVNLCVYVWLAIVYVYKKVDEGHQTSDQQGSSHKKYKPGV

SEQ ID NO: 27349 - protein, 978 aa, Bacillus cereus
MAEQTVRVTVDGKEFSASGEKTILQLFNESNLEHPQICHVPEVDPIQTCDTCIVEVNGKLLRACSTKLENGMHIERQSQRAKEAQTEAMDRILENHLLYCTVCDNNNGNCKVHNTVHMMGIEEQKYPYEPKVSACEVDMSHPFYRYDPNQCIACGQCVEVCQNLQVNETISIDWSLDRPRVIWDNGVSINESSCVSCGQCVTVCPCNALMEKSMLGEAGFMTGLKPDVLDPMIDFVKDVEPGYSSILAVSEVEAAMRKTKVNKTKTVCTFCGVGCSFEVWTKDRHILKVQPVSDAPVNGISTCVKGKFGWDFVNSEDRITKPLIRQGDMFVEASWEEALEVVASNMQHIKSEYGSDAFGFISSSKVTNEENYLMQKLARQIYGTNNVDNCSRYCQSPATDGLFKTVGMGGDAGTVKDIAEAGLVIIVGANPTEGHPVLATRVKRAHKLHDQKLIVADLRKHEMAERADLFIHPRQGTDYVWLAGITKYIIDQDWHDKKFIAENVKNFDEYSKMVEKYTLDYTEEITGISKENLKEMARMVYEADGTCVLWGMGVTQNTGGSTTSAAISNLLLVTGNYRRPGAGAYPLRGHNNVQGACDMATLPNWLPGYQAVSDDALRAKFEKAYGTTIPKAPGLNNIAMLLAADEGKLRGMYVMGEEMALVDSNANHVQHILANLDFLVVQDMFLSKTARFADVILPAAPSLEKEGTFTNTERRIQRLYEVLKPLGDSKPDWWILQKVARALGGDWNYENPSEIMDEIASLAPLYSQATYDRLEGWNSLCWGSHDGSDTPLLYVDGFNFPDKLARLSLDEWVPPVVAPDEYDLLLNNGRMLEHFHEGNMTNKSAGILSKVSEVFVEISPELALERNVKDGGLVELASPFGKIKVQALVTDRVMGKELYLPMHATVNEEAINILTGTATDLYTCTPAYKQTMVKMRVLREKGNRPLPSSNPRDKKRNPQNGVEIQQKWQRKQYVSLVD

SEQ ID NO: 27350 - protein, 349 aa, Robiginitalea biformata
MSDFHTLKVSRVRRLTPNAVAVSLEIPASQKERFKFTAGQYITVRSEATGSDVRRAYSISSRPGDAELTIGIKKVTDGTFSVFANESLREGDSLEVMPPEGRFTYEPGTPGRHLIAFAAGSGITPIMSILRTALEADAEARVVLVYGNQSRESTMFLEDLQALANEYPDRFIPYFTFSRGQYDDSLFGRIERSTVNYIVKNKHSDLEFDRYYICGPEPMIRTVEETLLDNGVPADRVLHELFETADQPDELREQLEGTTRLTVVLDEETHELNMDQKNVVLDAVLNEKIDAPYSCQGGICSTCIARIRSGTARMAQNQILTDSEIEEGLILTCQAHPTSPELTVDYDDV

SEQ ID NO: 27351 - protein, 334 aa, Burkholderia vietnamiensis
MFIENAWYAAALSAEVQREPFARTILNHKVVMYRTLADQVVALEDRCPHRQVPLSRGRVVGDELQCWYHGLRYDCSGACVGIPSQSTIPKGARVRAFPAVEKYGFIWLWTGDPDQADEAAIPNHWVCSAPELAGTMSYCTIACSYLFGIDNILDISHAAFVHAKTLGSLDIVETPPEIVIGEDEVRVRRYLRREKTPPLYTHILKLDYIDRFQEVLYWPIGNTRVETRAHACDDSSGRIFHVYTTTIFTPATDTTTHVFVGMHRDFDVDNERFTEFTAKEVFATVMEDKDVAESLQANWSPTAPMIDIQLDRPAFAARRILERMGARASIRATV

SEQ ID NO: 27352 - protein, 613 aa, Unknown
  Mycobacterium sp. JLS
MTEASARTIGPLPSRFSRDPKTPRSTDNAAAALLLAFTVLAILWANSPWAQSYSTFWDTHVAVSFGEYRAELSVKHLVNDGLMAFFFFIVGLEVKSEFVIGELTDRSRAAVPVVAAIAGLIVPAVIFLTFNPSGPDAQAWGVVISTDTAFLVGALAVIKPKFPARLRIFLLTLAVVDDVGALGAIALFYTDDLKLAPLAVAALLIAALAMVRRLPSLRGPAYAVLGFALWIALYLAHVHPTLAGVAVAVLIPVFTPERRQVEQTVDLVRAFRQSPNPQYARAVTRGLRESISINERLQTAVGPYVSFVVLPIFALANAGVHLDEQTITAAMSSTLTWGIVAGLVVGKFVGITAATALMSATGWGQLAPGLSLRRVAGGAALSGIGFTISLFIVDVAIEDPARQDEARVGVLIASVLAFTLSWALFRITDWISPPEPVGLTLVRPVDPERDHIRGDPDAPLVLVEYGDYECPFCGRATGAIDEVRTHFGDDLLYVWRHFPLERAHPRSFDAARASEGAAAQGKFFEMGRELFAHQDDLEWSDMYRYAVAIGLDIEQFDQDVRVHASKVLHRVRDDAQDAEVMDLNSTPTFFVNGKRHKGPWDAASLIRALEAGR

SEQ ID NO: 27353 - protein, 344 aa, Vibrio cholerae
MSETQNHNSYGKPVEMTVIGAGSYGTSLAISLARNGANIVLWGHDAEHMARLDADRANHEFLPGIAFPDTLIVETDLQKAVQASRDLLVVVPSHVFGIVLKSLQPHLRADSRICWATKGLEPETGRLLQDVAHDVLGDSYPLAVLSGPTFAKELAMGMPTAISVASPDAQFVRDLQEKIHCSKTFRVYANSDFIGMQLGGAVKNVIAIGAGMSDGIGFGANARTALITRGLAEMSRLGAALGAQPETFMGMAGLGDLVLTCTDNQSRNRRFGLALGQGKDVDTAQTDIGQVVEGYRNTKEVWMLAKRMGVEMPIVEQIYQVLYQGKDARLAAQDLLARDKKMER

SEQ ID NO: 27354 - protein, 631 aa, Unknown
  Oncidium Gower Ramsey
MEGCDCIEPQWPADELLVKYQYISDFFIALAYFSIPLELIYFVKKSSFFPYRWVLIQFGAFIVLCGATHLINLWTFTMHSRTVAIVMTVAKVSTAGVSCATALMLGHIIPDLVSVKTRELFLRNKAEELDREMGLIRTQEETGRHVRMLTHEIRSTLDRHTILKTTLVELGRTLDLAECALWMPLRTGLHLQLSHTLNNKIPVGSVVSINLPIVNQIFNSSRAGRIPNTCPLARFQPYTGRYVPQEVVAVRVPLLHLSNFQINDWPELSPKSFAVLVLMLPSDSARKWHAYELELVEVVADQVAVALSHAAILEESMRARDLLMDQNVALDLARREAEMAIRARNDFLAVMNHEMRTPMHAIIALSSLLLETELTPEQRLMVETILKSSNLLATLINDVLDLSKLEDGSFELEATIFNLHTVFREAVNLIKPIAAVKKLSLFVSLAPDLPSCAIGDEKRLLQIMLNVVGNAVKFTKEGTIFITVNIAKPDSLRDPDFYPAPTDGHFYLRVQVKDTGCGISPQELPHLFTKFAHTQNGSDKGYSGSGLGLAICKRFVNLMKGHIWLESEGIGKGCTTIFIVKLGMSEDPTLRYQQKLLPPIRAGQAEADPFGLKPAALKDELMPKIRYQRSL

SEQ ID NO: 27355 - protein, 112 aa, Unknown
  Candidatus Kuenenia stuttgartiensis
MKKIEAIIRPEKFNIVRDAMTEMGYPGMTVTEVKGHGSQKGISEVWRGRRYRVDLLSKIKLEIVVKDEDVQKIVDTITTEAQTGSIGDGKIFVINVENVYRIRTKEKDATAI

SEQ ID NO: 27356 - protein, 631 aa, Unknown
  Oncidium Gower Ramsey
MEGCDCIEPQWPADELLVKYQYISDFFIALAYFSIPLELIYFVKKSSFFPYRWVLIQFGAFIVLCGATHLINLWTFTMHSRTLAIVMTVAKVSTAVVSCATALMLVHIIPDLLSVKTRELFLRNKAEELDREMGLIRTQEETGRHVRMLTHEIRSTLDRHTILKTTLVELGRTLDLAECALWMPLRTGLHLQLSHTLNNKIPVGSVVSINLPIVNQIFNSSRAGRIPNTCPLARFQPYTGRYVPQEVVAVRVPLLHLSNFQINDWPELSPKSFAVLVLMLPSDSARKWHAYELELVEVVADQVAVALSHAAILEESMRARDLLMDQNVALDLARREAEMAIRARNDFLAVMNHEMRTPMHAIIALSSLLLETELTPEQRLMVETILKSSNLLATLINDVLDLSKLEDGSFELEATIFNLHTVFREAVNLIKPIAAVKKLSLFVSLAPDLPSYAIGDEKRLLQIMLNVVGNAVKFTKEGTVFITVNIAKPDSLRDPDFYPAPTDGHFYLRVQVKDTGCGISPQELPHLFTKFAHTQNGSDKGYSGSGLGLAICKRFVNLMKGHIWLESEGIGKGCTTIFIVKLGMSEDPTLRYQQKLLPPIRAGQAEADPFGLKPAAPKDELMPKIRYQRSL

SEQ ID NO: 27357 - protein, 493 aa, Methanosarcina mazei
MCGIAGMFGTPDSNTKVKKMLAILGHRGPDACGIHTEGKLSIGNTLLKITGDMPQPLTGTGSLVLNGEIYNFRELAAEIGLKTDSDTELLFTLIERKVRKGIKPTNAVFSVLSKVNGDYALAYACGTELVLARDPSGVKPLYYFYEKSMVKPGLAFASEKKALAFTGREVKPFPQGGIMGFSTENGKIAEKFTEKSLKITQPEKRISAEKEAIIYLKAALEKAVELRLTPVSGIAFSGGIDSTFLAALAKRIDPYVSLYAVGLPDSHDIAQAEYAAEAIGMKRNLKTHFLSPEEIEAAVPEVIYATESTDPMKVAIGLPLHIVAKTAREEGKRVLLTGQGADELFGGYSRHEGFFEQGADVLDREIYSDLENISAINLERDDMVAMANSVELRVPFLDKEVIKTGLAISPELKVRKKEGVYIRKYILRKAAEGLLPPKILWKEKKAVQYGTGVQKTLDRLARDSGFSKKQGGHIEKYLSQIASEKGFDFINEM

SEQ ID NO: 27358 - protein, 631 aa, Unknown
  Oncidium Gower Ramsey
MEGCDCIEPQWPADELLVKYQYISDFFIALAYFSIPLELIYFVKKSSFFPYRWVLIQFGAFIVLCGATHLINLWTFTMHSRTLAIVMTVAKVSTAVVSCATALMLVHIIPDLLSVKTRELFLRNKAEELDREMGLIRTQEETGRHVRMLTHEIRSTLDRHTILKTTLVELGRTLDLAECALWMPLRTGLHLQLSHNLNNKIPVGSVVSINLPIVNQIFNSSRAGRIPHTCPLARFQPYTGRYVPLEVVAVRVPLLNLSNFQINDWPELSPKSFAVLVLMLPSDSARKWHAYELELVEVVADQVAVALSHAAILEESMRARDLLMDQNVALDLARREAEMAIRARNDFLAVMNHEMRTPMHAIIALSSLLLETDLTPEQRLMVETVLKSSNLLATLINGVLDLSKLEDGSFELEATIFNIHTVFREAVNLIKPIAAVKKLSLFVSLAPDLPSCAIEDEKRLLQIMLNVVGNAVKFTKEGPIFITANTAKPDSLRDPDFYPAPNDGHFYLRVQVKDTGCGISPQEFPPLFTKFAHTQNGSDKGYSGSGLGPAICKRFINLMKGHIWLESEGTGKGCTTIFIVKLGMSEDPTLRYQQKLLPPIRAGQSEADPFGLKPAAPKGELLPKIRYQRSL

SEQ ID NO: 27359 - protein, 415 aa, Thermus caldophilus
MLRLDTRFLPGFPEALSRHGPLLEEARRRLLAKRGEPGSMLGWMDLPEDTETLREVRRYREANPWVEDFVLIGIGGSALGPKALEAAFNESGVRFHYLDHVEPEPILRLLRTLDPRKTLVNAVSKSGSTAETLAGVAVFLKWLKAHLGEDWRRHLVVTTDPKEGPLRAFAEREGLKAFPIPKEVGGRFSALSPVGLLPLAFAGADLDALLMGARKANETALAPLEESLPLKTALLLHLHRHLPVHVFMVYSERLSHLPSWFVQLHDESLGKVDRQGQRVGTTAVPALGPKDQHAQVQLFREGPLDKLLALVIPEAPLEDVEIPEVEGLEAASYLFGKTLFQLLKAEAEATYEALAEAGQRVYALFLPEVSPYAVGWLMQHLMWQTAFLGELWEVNAFDQPGVELGKVLTRKRLAG

SEQ ID NO: 27360 - protein, 574 aa, Unknown
  Oncidium Gower Ramsey
FGAFIVLCGATHLINLWTFTMHSRTLAIVMTVAKVSTAVVSCATALMLVHIIPDLLSVKTRELFLRNKAEELDREMGLIRTQEETGRHVRMLTHEIRSTLDRHTILKTTLVELGRTLDLAECALWMPLRTGLHLQLSHTLNNKIPGGSGGSINLPIVNQIFNSSRAGRIPNTCPLARFQPYTGRYVPQEVVAVRVPLLHLSNFQINDWPELSPKSFAVLVLMLPSDSARKWHAYELELVEVVADQVAVALSHAAILEESMRARDLLMDQNVALDLARREAEMAIRARNDFLAVMNHEMRTPMHAIIALSSLLLETELTPEQRLMVETILKSSNLLATLINDVLDLSKLEDGSFELEATIFNLHTVFREAVNLIKPIAAVKKLSLFVSLAPDLPSCAIGDEKRLLQIMLNVVGNAVKFTKEGTIFITANIAKPDSLRDPDFYPAPTDGHFYLRVQVKDTGCGISPQELPHLFTKFAHTQNGSDKGYSGSGLGLAICKRFVNLMKGHIWLESEGIGKGCTTIFIVKLGMSEDPTPRYQQKLLPPIRAGQAEADPFGLKPAAPKDELMPKIRYQRSL

SEQ ID NO: 27361 - protein, 115 aa, Unknown
  Candidatus Kuenenia stuttgartiensis
MVVMKKIEAIIRDQKLTAVKDALKAIGVAGMTVSEVKGHGTQKGITEVYRDKQYSVDLLPKIKIEIITTDENVDKITKTIVDAAQTGSIGDGKIFIYDIRDVIRIRTGDTGEKAI

SEQ ID NO: 27362 - protein, 563 aa, Saccharomyces cerevisiae
MSEITLGKYLFERLKQVNVNTVFGLPGDFNLSLLDKIYEVEGMRWAGNANELNAAYAADGYARIKGMSCIITTFGVGELSALNGIAGSYAEHVGVLHVVGVPSISAQAKQLLLHHTLGNGDFTVFHRMSANISETTAMITDIATAPAEIDRCIRTTYVTQRPVYLGLPANLVDLNVPAKLLQTPIDMSLKPNDAESEKEVIDTILALVKDAKNPVILADACCSRHDVKAETKKLIDLTQFPAFVTPMGKGSIDEQHPRYGGVYVGTLSKPEVKEAVESADLILSVGALLSDFNTGSFSYSYKTKNIVEFHSDHMKIRNATFPGVQMKFVLQKLLTTIADAAKGYKPVAVPARTPANAAVPASTPLKQEWMWNQLGNFLQEGDVVIAETGTSAFGINQTTFPNNTYGISQVLWGSIGFTTGATLGAAFAAEEIDPKKRVILFIGDGSLQLTVQEISTMIRWGLKPYLFVLNNDGYTIEKLIHGPKAQYNEIQGWDHLSLLPTFGAKDYETHRVATTGEWDKLTQDKSFNDNSKIRMIEIMLPVFDAPQNLVEQAKLTAATNAKQ

SEQ ID NO: 27363 - protein, 434 aa, Corynebacterium glutamicum
MTDAHQADDVRYQPLNELDPEVAAAIAGELARQRDTLEMIASENFVPRSVLQAQGSVLTNKYAEGYPGRRYYGGCEQVDIIEDLARDRAKALFGAEFANVQPHSGAQANAAVLMTLAEPGDKIMGLSLAHGGHLTHGMKLNFSGKLYEVVAYGVDPETMRVDMDQVREIALKEQPKVIIAGWSAYPRHLDFEAFQSIAAEVGAKLWVDMAHFAGLVAAGLHPSPVPYSDVVSSTVHKTLGGPRSGIILAKQEYAKKLNSSVFPGQQGGPLMHAVAAKATSLKIAGTEQFRDRQARTLEGARILAERLTASDAKAAGVDVLTGGTDVHLVLADLRNSQMDGQQAEDLLHEVGITVNRNAVPFDPRPPMVTSGLRIGTPALATRGFDIPAFTEVADIIGTALANGKSADIESLRGRVAKLAADYPLYEGLEDWTIV

SEQ ID NO: 27364 - protein, 409 aa, Pseudomonas pseudoalcaligenes
MSKTIPIVDAQHAGSAYQHVPGHPDPQLSAVAKGTPTGEYLRRYWQPVALSADVTDRPQMVRILGEDLVLFRDKAGRPGLLYPRCMHRGTSLYYGHVEEAGIRCCYHGWLFAVDGTCLNQPCEPEGGLRREAARQPWYPVEERYGLVFAYMGPPEKKPVLPRYDILEDLEEGEFIEVISGGFVSYADHVEDPNVPYHWLQNWENIMDPYHVYILHSTFSGIQFAENFKILPRVDFEAVDGGVIYHAWRDLEDGRQLERINSALFPNISAIPMIDLSPGQGRWIGWHVAVDDQHYRGFFAARTRQPGNFAPIKMHNGKSWTELSEQEKQDFPGDFEAQFGQGRVTLHGEEHLATSDHGIALLRRQMKQQIAIVQQGGDPAGVHFNEADALVRIRSGNFYTTSDKTETAAD

SEQ ID NO: 27365 - protein, 421 aa, Neisseria meningitidis
MSEALAKETLNPFEIARKQVKTACDRLKTDPAVYEILKSPTRVLEVNFPVKLDDGTVKTFTGYRSQHNNAVGPYKGGVRFHPGVNLDEVKALSIWMTIKCCVAGIPYGGGKGGVTLNPRDYSEAELERIARAYSEAISPLIGEKIDIPAPDVNTNGKIMSWMVDAYENVVKHSAPGVFTGKPVEFGGSLARTEATGYGVNLAAVQALEKLGKDVKGATYAIQGFGNVGYHTGYYAHQSGAKVVAVSTVDVAIYNENGLDMEAIIKEFQTKGFITNEAGYGKEITNAELLALEVDVLAPCALENQLTSENAGKVRATIVVEGANGPTTPEADVILRQNGVLVVPDILANCGGVVVSYFEWVQNLQGYYWEFDEVQEKETVVLRRAFRDIWNLAQEYDVDLRTASYMMSIRRVEKAMKLRGWY

SEQ ID NO: 27366 - protein, 369 aa, Malus sylvestris
MEDGAGRGLECQKTMDGKGSNGNGSEKAIPSCCLKAMASTPEAEAKCHSTVVSGWFSESQSRSEKDCKKVYFNNPMWPGEAHSLKVENILYRGKSEYQEILVFESSIYGKVLVLDGIIQLSEKDECAYQEMIAHLPLCSISSPKTVLVVGGGDGGVLREVSRHPSIEHIDICEIDKMVIDVSKKFFPQLAVGFQDPRVHLHVGDATEFLRLAPEGKYDAVIVDSSDPVGPAQELVEKPFFETIARALRPGGVLCNMTESMWLHTHLIQDMISVCRQIFKGSVNYAWASVPTYPSGVIGFLLCSTAGPPVDFKNPVNSIEKLERALKHKRELKFYNSEMHSAAFALPPFLRREVSALRESSTPARQIGEK

SEQ ID NO: 27367 - protein, 1064 aa, Clostridium perfringens
MFDSVKRKLVCYDDNEYYIEISPLTNTIRATLCCKGAIEAYLVGDFNNWEKSENFKLNWGLDTNDGRVKMIKDITFPCGLKKGEYKYGYIIITLDGKEIYVDNLNEEKNDFYFLWEPFEESLEIKSSRDFISTRYPVELIAVKNSFYGNITIEDAVLSIENSLKGVILENGFLKINEEVAPGTKIIVKAYDSLNDMTAYKEIEVREEGEKGTFVQFLKNDGLYYGENFSWNIWGFGKNSSGKEFNLNIKTDLGVGTFVDEEKFIVRKRTWGCNWVNDWNEQTYTFYLGKEDRNLFCIYENNKILTSLKTAIEETTPKIQVALMDHKNTIKAYLSHKPLIGVKYGLYINGIKAKGVSTLVRENEKEVLITNLPSDIDPSDLLEVRASSMFSSCKVIVRDYLNDYYYGGNDLGVRFSEENISLRLWAPTAKKVELLIYEDYKSLRENPLRKYDMNREKENGTHLIKVQRKENEGKYYLYRLYFNDLSKEGKHVNKITYAVDPYAVSVGVNGEKGALVDLFSKECVPEGWNKYNKPKLINKEDSIIYEMHIRDFTINENSGVSESLRGKFLGAVEEGTFYINKENGNKVKTGLDHLKELGITHVHLLPVFDFSSVNEEITKDENNRNWGYDPKNFNAIEGSYSTDPYTPSRRIIEFREMIKKFHDNGIRVVLDMVYNHMYETSNMDNIVPLYYFRSDKLGKYTNGSGCGNEMASEKPMVRKFILDSILHWIKNYHIDGLRFDLMELIDLDTMKEIVKRSEEIDEKILIYGEPWKGGDSPLSNGTYKGSQKGLGFSIFNDDFRNALRGNNDPSNGFINGEQHNKNKAWQVIEGIKGSINSITYKPMESINYLESHDNYTLWDQIVKSQNHSVEKGHYRDFNEENILDNFYVKEDLLGASILFTSQGIPFIQSGAEILRSKDGDHNSYKSPDSINALNWAEKEKYIDVFNYYKDLISLRKNHSAFRMKNPEDIIENLEVYFYDNNDTSGVIIAHYKNNANEDLWKDIVVIYNGTTIDDYNVISSMPKSSNGFWNIAVKNGGVNQFGIERVSEDEIPKIKSHSMMILYDE

SEQ ID NO: 27368 - protein, 266 aa, Hordeum vulgare
APQGAEVTGLPGFDGALPSKHYAGYVTVDEGHGRNLFYYVVESERDPGKDPVVLWLNGGPGCSSFDGFVYEPGPFNFESGGSVKSLPKLHLNPYAWSKVSTMIYLDSPAGVGLSLYSKNSDYETGDLKTATDSHTFLLKWFQLYPEFLSNPFYIAGESYAGVYVPTLSHEVVKGIQGGAKPTINFKGYMVGNGVCDTIFDGNALVPFAHGMGLISDEIYQQASTSCHGNYWNATDGKCDTAISKIESLISGLNIYDILEPCYHSRS

SEQ ID NO: 27369 - protein, 313 aa, Streptococcus pyogenes
MTKIYKTITELVGQTPIIKLNRLIPNEAADVYVKLEAFNPGSSVKDRIALSMIEAAEAEGMISPGDVIIEPTSGNTGIGLAWVGAAKGYRVIIVMPETMSLERRQIIQAYGAELVLTPGAEGMKGAIAKAETLAIELGAWMPMQFNNPANPSIHEKTTAQEILEAFKEISLDAFVSGVGTGGTLSGVSHVLKKASPETVIYAVEAEESAVLSGQEPGPHKIQGISAGFIPNTLDTKAYDQIIRVKSKDALETARLTGAKEGFLVGISSGAALYAAIEVAKQLGKGKHVLTILPDNGERYLSTELYDVPVIKTK

SEQ ID NO: 27370 - protein, 350 aa, Malus sylvestris
MGEAVEFYHANGNGFSKFSEKFDPKAVVLLNGSNHIERDIDSSWYEETIDDDLKWSFALNVNGVLHKGTSEYQEIALLDTKRFGKVLIIDGKMQSAEVDEFIYHECLIHPALLCHPKPERIFIMGGGEGSAAREALKHKLLDKVTMCDIDQEVVDFCRRHLTVNQEAFSHHKLNLIINDAKAELEKSCEKFDIIVGDLADPVEGGPCYQLYTKSFYDKILKPKLNHGGIFVTQAGPAGIFTHKEVFTSIYNTVKQVFKYVVPYAAHIPSFADTWGWVMASDEPFFINAEKMDRRIEERIDGELNYLNGAQFMSSATMNKTVSLSLLNETHVYTEEDARFVHGHGVAYRIY

SEQ ID NO: 27371 - protein, 849 aa, Nocardia farcinica
MNPATTERKTVVVVGHGMVGHRFVEALRSRDESGTWQVVILSEERLPAYDRVGLSSYVGAWDPAALALPGNDYAGDELVELRLGQRAEAIDRQARKVTTATGETIGYDALVLATGSYAFVPPVPGHDLDGCFVYRTIDDLDGIRATAEAAGPGAHGVVIGGGLLGLEAANALKLLGMTPHVIEYNNRLMPAQVDEGGGAILERLVTDLGLTVHTGVGTQSIERAEDGTLRLTLSDDSTIDASMVVFSAGIRPNDRIAREAGLEVGPRGGIVTDLSLQTSDPNIWAVGECAAVEGTCYGLVAPGYTTAEIVADRLLGGRGEFPGADMSTKLKLMGVDVASFGDAHGVTEGALSVVLHDAAKGTYAKLVVSDDATTLLGGILVGDASQYAALRPLVGRPLPAAPAALISPAGAELGADALPDDAQICSCNNVSKGAICGAIAEGACDIPAIKSCTTAGTSCGGCVPMLKKLLEQSGVAMSKALCEHFEQSRAELFQIVQVTGIRTFSGLIAKYGKGSGCDICKPTVASILASTSSDHILDGEMAALQDTNDHFLANLQKNGTYSVVPRMPGGEVTAEQLITIGEVAKEFGLYVKVTGGQRIDLFGARVEQLPRIWQRLVDAGMESGHAYGKSLRTVKSCVGSTWCRYGQQDSVGMAVLLEKRYRGLRSPHKLKLAVSGCARECAEARGKDVGVIATENGWNLYVGGNGGLTPKHAVLLAGELDDETLIRYIDRYLMFYIRTADRLQRTAPWQEALEGGIDYLKQVICEDSLGIADELEAAMARHVEGYKDEWAAVLEDEEKLARFVSFVNAPEEADPTIAFDDSGERKVPVLLGMPEVAPRVESVTAAQAK

SEQ ID NO: 27372 - protein, 350 aa, Malus sylvestris
MGEAVEFFHTNGNGFCKFSEKFDPKTVVILNGSNHVERDRDSSWYEETIDDDLKWSFALNVNGVLHKGTSEYQEIALLDTRRFGKVLVIDGKMQSAEVDEFIYHECLIHPALLCHPKPKNVFIMGGGEGSAAREALKHKLLDKVTMCDIDQEVVDFCRRHLTMNQEAFSHHKLNLVINDAKTELEKSCEKFDIIVGDLADPVEGGPCYQLYTKSFYEKILKPKLNHGGIFVTQAGPAGIFTHKEVFTSIYNTIKQVFKYVVPYAAHIPSFADTWGWVMASDEPFSINGEKMDRRIEERIDGELNYLNGALFISSATMNKTVSLSLLNETHVYTEEDARFIHGRGVACRIN

SEQ ID NO: 27373 - protein, 520 aa, Pyrus communis
DVQYLTGHVDERKPPQLADFLNWFLHDKKGTSTLSKPSSTGHRPHHVRVTGRLSTSCHLVDEDRELLLPRRHHNDDDHDNHVSSIFIDQSLTDGGEGGQIIKETSLLPGDQTRFGLESSLMRLELKGNSPHCLVQSDIPPCVQGDASEALDVTATAVASLEECARLSEENDVVQQAYRKEIVVSRNQVIRNSVEQPKVTLYNQSDLEGVHSELVKQGRITAVTNPRYLNLEPTLAMDWLEISWDELNIKERVGAGSFGTVHRAEWNGSDVAVKVLTVQDFHDDQLKDFLREVAIMKRVLHPNVVLFMGAVTKRPHLSIVTEYLPRGSLYRLIHRPASGELLDQRRRLRLALDVAKGINYLHCLNPPIVHWDLKSPNLLVDKNWTAKVCDFGLSRFKANTFISSKSVAGTPEWMAPEFLRGEPSNEKSDVYSFGVILWELATMQQPWGNLNPAQVVAAVGFKNKRLEIPRDLNPNVAAIIEACWANEPWKRPSFAVIMDSLTPLIKAPVTQPSRADMPLLT

SEQ ID NO: 27374 - protein, 741 aa, Pyrus communis
MEACNCIEPQWPADELLMKYQYISDFFIALAYFSIPLELIYFVKKSAVFPYRWVLVQFGAFIVLCGATHLINLWTFNMHSRTVAIVMTTAKVLTAVVSCATALMLVHIIPDLLSVKTRELFLKNKAAELDREMGLIRTQEETGRHVRMLTHEIRSTLDRHTILKTTLVELGRTLALEECALWMPTRTGLELQLSYTLHQQNPVGYTVPIHLPVVNQVFSSNCAVKISPNSPVARLRQLAGKHIPGEVVAVRVPLLHLSNFQINDWPELSTKRYALMVLMLPSDSARQWHVHELELVEVVADQVAVALSHAAILEESMRARDLLMEQNIALDLASREAETAIRARNDFLAVMNHEMRTPMHAIIALSSLLQETDLTPEQRLMVETILKSSNLLATLINDVLDLSRLEDGSLQLDIATFNLHSIFREVHNMIKPVASIKRLSVALNIAADLPVYAIGDEKRLMQIILNVVGNAVKFSKEGSISITAYVAKSESLRDFRAPDFFPVQSDNHFYLRVQVKDSGSGINPQDIPNLFTKFTQTQTLASQNSGGSGLGLAICKRFVNLMEGHIWIESEGLGKGCTATFIVKLGFPERSNESKQPFAPKLQANHVQTNFPGLKVLVMDDNGVSRSVTKGLLVHLGCDVTTVSSIDEFLHVISQEHKVVFMDVCMPGIDGYELAVRIHERFTKRHERPVLVALTGSIDKMTKENCMRVGMDGVILKPVSVDKMRSVLSELLEHRVLFEAM

SEQ ID NO: 27375 - protein, 391 aa, Chlamydophila abortus
MDYYDVLGVSKTASPEEIKKSYRKLAVKYHPDKNPGDAEAEKRFKEVSEAYEVLSDPQKRESYDRYGKDGPFAGAGGFGGAGMSNMEDALRTFMGAFGGELGGSGSFFEGLFGGLGEAFGMRGDPAGARQGASKKVHITLTFEEAARGVKKELLVSGYKTCETCSGSGASSKQGIKCCDRCKGSGQVVQSRGFFSMASTCPECGGEGRMITDPCSSCRGQGRIKDKRSVHVQIPAGVDSGMRLKMEGYGDAGQNGAPAGDLYVFIDVEAHPVFERRGDDLILELPIGFVDAALGMKKEVPTLLKEGACRLTVPEGIQSGTILKIKNQGFPNVHGRGRGDLLVRVSVETPQNLSEEQKELLRKFAATEKAENFPKKRSFLDKIKGFFSDLTV

SEQ ID NO: 27376 - protein, 186 aa, Arabidopsis thaliana
MENNNNNHQQPPKDNEQLKSFWSKGMEGDLNVKNHEFPISRIKRIMKFDPDVSMIAAEAPNLLSKACEMFVMDLTMRSWLHAQESNRLTIRKSDVDAVVSQTVIFDFLRDDVPKDEGEPVVAAADPVDDVADHVAVPDLNNEELPPGTVIGTPVCYGLGIHAPHPQMPGAWTEEDATGANGGNGGN

SEQ ID NO: 27377 - protein, 487 aa, Arabidopsis thaliana
MDTPQKSITQIGTPISKSRFERASNSEARFRNGVEKQTMQHDSNKEPESANAIPYEAVSLLHRGIRRRCLDFEMPGNKQTSSENNTAACESSSRCVVPSIGLHLNAILMSSKDCKTNVTQDYSCSANIQVGLQRSISTLQDSLDQTENEIREDADQDVPVEPALQELNLSSPKKKRVKLDSGEGESCKRCNCKKSKCLKLYCECFAAGVYCIEPCSCIDCFNKPIHEDVVLATRKQIESRNPLAFAPKVIRNSDSVQETGDDASKTPASARHKRGCNCKKSNCLKKYCECYQGGVGCSINCRCEGCKNAFGRKDGSSIDMEAEQEEENETSEKSRTAKSQQNTEVLMRKDMSSALPTTPTPIYRPELVQLPFSSSKNRMPPPQSLLGGGSSSGIFNSQYLRKPDISLSQSRIEKSFETVAVDGAEQMPEILIHSPIPNIKSVSPNGKRVSPPHMESSSSGSILGRRNGGRKLILQSIPSFPSLTPQH

SEQ ID NO: 27378 - protein, 311 aa, Corynebacterium efficiens
MGNVYNNITETIGRTPLVKLNRLTEGLDATVLVKLESFNPANSVKDRIGLAIIDAAEASGELKPGGTIVEATSGNTGIALAMVGAARGYKVVLTMPETMSTERRVLLRAYGAEIVLTPGAAGMQGAKDKADEIVAERENAILARQFENPANPEIHRETTAKELMEDTDGNFDIFVAGFGTGGTITGVGGVLKEHNPEAQVYAVEPEASPLLTSGKAGPHKIQGIGANFIPENLDRKILDDVITISNEDAVTWSRKLATEEGILGGISTGANIKAALDLAAKPENAGKTIVTTVCDFGERYVSTVLYEDIRD

SEQ ID NO: 27379 - protein, 89 aa, Unknown
  Acidovorax sp. JS42
MSNKEQLIEMQGKVDEVLPDSRFRVVLENGHTLIAYSGGKMRKHRIRVLAGDTVSLEMSPYDLTKGRITFRHLEPRAGGAPRRPSPHRR

SEQ ID NO: 27380 - protein, 329 aa, Bdellovibrio bacteriovorus
MAQFDKKIQKIGVYTSGGDAPGMNAAIRAVVRVGISQKLEVYGIHNGYVGMIENKIEPLQLRDMANIIQRGGTILKTGRSTEFMRPEGRARAAQNIKNLGLDALVCIGGDGSFRGAHALWEEHQIPVVGVPGTIDNDIFGSDKTIGFDTAVNTALEAIDRIRDTAASHDRLFIVEVMGRNSGFIASHVGLAGGAEEIFTPDANTTVEKAIDRINEAKSRGKTSSIIITAEGQKPGRAYDLADAIRKKSGMDAKVCILGHQQRGGSPTAADRILASRMGAAAVDALFKGYCDVMIGTEGERLIQVPLDLVYKNEKKNQLDLISLASVLAT

SEQ ID NO: 27381 - protein, 340 aa, Unknown
  Cycloclasticus sp. A5
MTSYNVKISGQELEFACEEGDTILRAALRAGVGMPYECNSGGCGACKVEVLNGEVENIWEDAPGLSPRDIKKGRKLSCQCIPTEDLEIKVRLNPEAMPLHKPIKGKAVLFEINKLTEDMAEFCFKTEHPAHFKAGQFALLDFPGITGSRGYSMCNLPNEEGEWRFIIKKMPDGSATTTLFEDYEVGAEIVIDGPYGLAYLKPEIPRDIVCVGGGSGLSPEMSIIKAAARDPQLNDRNIYLFYGGRTPSDICPPKLIEADDDLRGRVKNFNAVSDVEAAEAAGWNGDVGFIHELLGKTLGEKLPEHEFYFCGPPPMTDALTRMLMTEYKVPFDQIHYDRFY

SEQ ID NO: 27382 - protein, 423 aa, Glycine max
  misc_feature (41)..(41): Xaa can be any naturally occurring amino acid
MVGEGEKPKAVIIGGSIAGISSAHALTLAGWDVLVLEKTTXPPTGSPTGAGLGLNSLSQQIIHSWLPPHQKQLLHNTTLTLTIDQNHATDSEKKFSWTLTRDESFNFRAAHWADLHGLLYNALPPNVFLWGHLFLSVHVADDKGSVIVKAKVLETGKIIEIVGDFLVAADGCLSSLRQKYLPDFKLRYSGYCAWRGVLDFSKIENSETINGIRKAYPDLGKCLYFDLASGTHTVLYELQNKKLNWIWYVNQPEPEVKGTSVTMKVNNDMIQKMHQEAEQVWIPELVKVIKETKDPFLNFIYDSDPLEKIFWDNVVLVGDAAHPTTPHCLRSTNMSILDAAVLGKCIEKWGPEKLGSALEEYQFVRLPVTSKEVLYSRRLGRLKQGLVLPDREPFDPKLIRPEDCQELLLRNTPFFNDEPLSLL

SEQ ID NO: 27383 - protein, 574 aa, Unknown
  Oncidium Gower Ramsey
FGAFIVLCGATHLINLWTFTMHSRTLAIVMTVAKVSTAVVSCATALMLVHIIPDLLSVKTRELFLRNKAEELDREMGLIRTQEETGRHVRMLTHEIRSTLDRHTILKTTLVELGRTLDLAECALWMPLRTGLHLQLSHTLNNKIPVGSVVSINLPIVNQIFNSSRAGRIPNTCPLARFQPYTGRYVPQEVVAVRVPLLHLSNFQINDWPELSPKSFAVLVLMLPSDSARKWHAYELELVEVVADQVAVALSHAAILEESMRARDLLMDQNVALDLARREAEMAIRARNDFLAVMNHEMRTPMHAIIALSSLLLETELTPEQRLMVETILKSSNLLATLINDVLDLSKLEDGSFELEATIFNLHTVFREAVNLIKPIAAVKKLSLFVSHAPDLPSCAIGDEKRLLQIMLNVVGNAVKFTKEGTIFITANIAKPDSLRDPDFYPAPTDGHFYLRVQVKDTGCGISPQEFPHLFTKYAHTQNGSDKGYSGSGLGLAICKRFVNLMKGHIWLESEGIGKGCTTIFIVKLGMSEDPTPRYQQKLLPPIRAGQAEADPFGLKPAAPKDELMPKIRYQRSL

SEQ ID NO: 27384 - protein, 249 aa, Pseudomonas syringae
MTVYFIGAGPGDPELITVKGQRLIRTCPVIIYAGSLVPLAVLEGHQAVQVTNSAELHLEQIIDRIKTAHAQGQDVARVHSGDPSLYGAIGEQIRHLRELNIPFEIIPGVTATAACAALLGVELTLPDISQSVILTRYADKTSMPSGEELASLASHRATMAIHLGVNNLHRIVEELTPHYGTDCPIAVVHRASWPDQEWAIGTLADIEEKVRAKGFRRTALILVGRVLAADTFGESSLYRAGHAHLFRPK

SEQ ID NO: 27385 - protein, 71 aa, Robiginitalea biformata
MAKQAPIEQDGSIIEALSNAMFRVELENGHVVTAHISGKMRMHYIKLLPGDKVKLEMSPYDLTKARITYRY

SEQ ID NO: 27386 - protein, 221 aa, Vitis vinifera
MANSDHIVLLDYSASPFAMRVRLALAAKGIEYLIKEEDLTQSKSSLLLKVNPVHQKIPVLIHNGKPVCESLIIVEYIDEVWKDRCRLLPADPYQRAKAKFWADFIDKMVYPSCYNVWAANGEVQEAGKKEFIDRIKMLEGELKSNPYFGGETLGFLDIGFLPSYYWFHTFETFGKFNIEAECPKLVAWGKRCMEEEFVYTSLPHPHKVYDLVVDYRKKMGI

SEQ ID NO: 27387 - protein, 520 aa, Solanum habrochaites
MKSTVHLGRVSTGGFNNGEKEIFGEKMRGSLNNNLRINQLSKSLKLEKKEKKIKPGVAYSVITTENDTETVFVDMPRLERRRANPKDVAAVILGGGEGTKLFPLTSRTATPAVPVGGCYRLIDIPMSNCINSAINKIFVLTQYNSAALNRHIARTYFGNGVSFGDGFVEVLAATQTPGEAGKKWFQGTADAVRKFIWVFEDAKNKNIENILVLSGDHLYRMDYMELVQNHIDRNADITLSCAPAEDSRASDFGLVKIDSRGRVVQFAEKPKGFELKAMQVDTTLVGLSPQDAKKSPYIASMGVYVFKTDVLLKLLKWSYPTSNDFGSEIIPAAIDDYNVQAYIFKDYWEDIGTIKSFYNASLALTQEFPEFQFYDPKTPFYTSPRFLPPTKIDNCKIKDAIISHGCFLRDCSVEHSIVGERSRLDCGVELKDTFMMGADYYQTESEIASLLAEGKVPIGIGENTKIRKCIIDKNAKIGKNVSIINKDGVQEADRPEEGFYIRSGITIISEKATIRDGTVI

SEQ ID NO: 27388 - protein, 291 aa, Streptomyces avermitilis
MELGLVGLGKMGGNMRERIRRAGHTVIGYDRNPDVADVHSLEELVGKLKGPRVVWVMVPAGAATQSTVDELGELLEPGDIVVDGGNSRWTDDEKHAEELAAKGIGFVDCGVSGGVWGLQNGYALMYGGDAENIAKVQPIFDALKPEGDFGAVHAGKVGAGHFSKMVHNGIEYAMMQAYAEGWELLEKVDSVTDVREVFRSWQEGTVIRSWLLDLAVNALDGDEHLEKLRGYAEDSGEGRWTVEAAIDNAVPLPAITASLFARFASRQDDSPQMKMIAALRNQFGGHAVEKK

SEQ ID NO: 27389 - protein, 162 aa, Debaryomyces hansenii
MDKTSFYDFKPLDVYGEVYDFSQLKGKVVVIVNVASLCGFTLQYKDLEYLYKTYKERGFVVLGFPCNQFGSQEPYTEREILQICEKKFGVTFPIMDKIEVNGECEDPLYGYLKNEQRTSLGFKGIKWNFEKFLISRSGRVVKRYDSTVAPLNFEKAIVELLE

SEQ ID NO: 27390 - protein, 393 aa, Methanosarcina barkeri
MDIYSVPEIAKDVFWVGAKDWSRRMFDALVPLPQGTSYNAYLVKGEEKTALIDTVNPGFEEEFEEKINLVSSLEKLDYLIMNHAEPDHASAIRYIMDRAPGSVLVTTERGVKMASLYHDLPDDRIKVVADGDTIDLGGKNLHFIEAPWLHWPETMFTYLPEGRVLFPCDFFGAHTAQGVYDEDLEDLIPLAKSYYGEIMMPFGKMGAKALEKIKDLDIAVIAPSHGPIYKNPQRILEPYAKWTAGKTENKALIVYVSMWGSTKLMVRTIAETLLKEGVDVRIYDLEVANTGDIARELVDSRAVILGTPTVLAGMHPLALYGTYLVKALKPPAKYGVILGSFGWGGGALKQAGEILVPSKMEIVGTLQVKGKPREEDLNKIEGIGRELARKMKA

SEQ ID NO: 27391 - protein, 412 aa, Desulfovibrio desulfuricans
MDELLIQDPEVGRAIVQEVERQTGKLELIASENFVSPAVRAAQGSVLTHKYAEGYPGKRYYGGCEFVDVAENLAIDRACEIFGAQYANVQPHSGSQANMAVYFSALTPGDTILAMDLSHGGHLTHGSPVNFSGRFYNVVFYGVSRETGCIDYDSVAELAREHRPAMIVAGASAYSRIIDFARFRAIADEVGSLLMVDMAHIAGLVAAGLHPSPVGTAHFTTTTTHKTLRGPRGGMILSDEEAAKKLNSQIFPGIQGGPLMHVIAAKAVAFGEALRPEFGAYQKQVVANAAKLAATLTDAGFELVSGGTDNHLMLVDLTNKDITGKDAQHALDLAGITANKNTVPFETRSPFVTSGIRLGTPALTTRGMKEAEMVKVAGWIIDALGNIGNETRLAEISRDVEKFARQFPLFHW

SEQ ID NO: 27392 - protein, 285 aa, Methylococcus capsulatus
MCDAQDWFTESYPDNGSALSLKIRAKLHEEQTPFQRIEIYDTESFGKLMVIDGCTMVSDRDNFLYHEMMTHPVLYTHPAPKTVWIIGGGDCGSLREVLKHSEVEKAVQIDIDERVTRLAERYFPELCEANGDPRAELLFIDGIQWVKEAPDGCVDVIIVDSTDPVGPAEGLFNEAFFRQCHRCLRTDGILVQQSESPLFHLPLIASMHRIMRQAGFAQTRTLFFPQFIYPSGWWSATMAGKGDLNRFRADAAEAKLFPTRYYNADIHRAAFAVPEFFGDALRELV

SEQ ID NO: 27393 - protein, 424 aa, Brassica rapa
MATPMVEDTSSFEEDQLASMSTEDIVRATRLLENEIRILKEDAQRTNLECDSYKEKIKENQEKIKLNKQLPYLVGNIVEILEMNPEDDAEEDGANIDLDSQRKGKCVVLKTSTRQTIFLPVVGLVDPDSLKPGDLVGVNKDSYLILDTLPSEYDSRVKAMEVDEKPTEDYNDIGGLEKQIQELVEAIVLPMTHKERFEKLGVRPPKGVLLYGPPGTGKTLMARACAAQTNATFLKLAGPQLVQMFIGDGAKLVRDAFQLAKEKAPCIIFIDEIDAIGTKRFDSEVSGDREVQRTMLELLNQLDGFSSDERIKVIAATNRADILDPALMRSGRLDRKIEFPHPTEEARARILQIHSRKMNVHPDVNFEELARSTDDFNGAQLKAVCVEAGMLALRRDATEVNHEDFNEGIIQVQAKKKASLNYYA

SEQ ID NO: 27394 - protein, 322 aa, Unknown
  Nocardioides sp. JS614
MNLPDLPRLHLVLAPTPLVHAPRLSEAVGVEVWFKRDDLTGRGLGGNKVRTLEYLLGDAVAKGCDALVTGAGPQSNWAMLAALSARTAGFSPHLVFYGDPPEASGNLLLTQVTCTDIRYTGELDRCSVDSMLGKVADELVAAGRFPYVVPRGGATPLGCLGYLRAAVELVRQLPEVGVDPATLWVPTGSGGTQAGLLAGAHWLGWDVAVVGVATSRTPEEAQVRVGELASATLELLDADDTARAAPHVLGGFLGDGYGEVSPAGTAAAELVARTEGIFLDPVFGAKAMAALLAEVRHGTVRGPVIFLVTGGAPTLFMKGTEL

SEQ ID NO: 27395 - protein, 469 aa, Saccharomyces cerevisiae
MPYTLSDAHHKLITSHLVDTDPEVDSIIKDEIERQKHSIDLIASENFTSTSVFDALGTPLSNKYSEGYPGARYYGGNEHIDRMEILCQQRALKAFHVTPDKWGVNVQTLSGSPANLQVYQAIMKPHERLMGLYLPDGGHLSHGYATENRKISAVSTYFESFPYRVNPETGIIDYDTLEKNAILYRPKVLVAGTSAYCRLIDYKRMREIADKCGAYLMVDMAHISGLIAAGVIPSPFEYADIVTTTTHKSLRGPRGAMIFFRRGVRSINPKTGKEVLYDLENPINFSVFPGHQGGPHNHTIAALATALKQAATPEFKEYQTQVLKNAKALESEFKNLGYRLVSNGTDSHMVLVSLREKGVDGARVEYICEKINIALNKNSIPGDKSALVPGGVRIGAPAMTTRGMGEEDFHRIVQYINKAVEFAQQVQQSLPKDACRLKDFKAKVDEGSDVLNTWKKEIYDWAGEYPLAV

SEQ ID NO: 27396 - protein, 126 aa, Ashbya gossypii
MSLQSSRLPITLVPLSQIRRPVAPVLDPQKIDAMVSTARGVPAASATCSLEDAAAMDGQLPPVDVMHVRHDSADYYFAFGGCHRLQAYDRMAQEGQEDVLVRCKLLPATRAQMRTYVGASVDNLFN

SEQ ID NO: 27397 - protein, 456 aa, Unknown
  Nocardioides sp. JS614
MRRRLVVVGAGAAGMSAASAARRVDNHLEVVVLEAGNHAAYGLCGLPYFLSHVVADVDSLRAYPPTYFRDQRDIDLRFGAEVVRIDAERQVVHHRTAGRTGLLHYDKLILTAGATAFLPAVPGLDDDHVFTVRDVAESVRLRGLLDAGHVGHATVVGGGYIGLEVAESLAERGISVTLVEALPRLMANLDPELSQRVQDEVEQHVVVRLNSALSSLVRTDRGLTLRLADGSAIETDVVIVATGVRPASTLGSSIGANTGPGGALLVDEHMRTSVPNVYAAGDCIAPNHIATGRPAFIPLGPTANKTGRVAGTVAAGGSACFAGIAGTAIVKVFGIGVGRTGLTLVEALSEGFDAQATDAVGRSRAKYFPGSAQVDVRLVHTGDGRLLGAQFVGQGDDVAKRVDVTAVALHAGLGVEDLADLDLSYAPPFAPVYEPVLLAANAAVAALKPLRLAAGE

SEQ ID NO: 27398 - protein, 434 aa, Unknown
  Oceanospirillum sp. MED92
MSHSDLYRNDAVCEAFFTQDLTSRDAELQSALNEEFDRQEMGIELIASENIVSKAVMQAQGTVLTNKYAEGYPGRRYYGGCEYADKAEGLAIERAKQLFDCEFVNVQPHSGAQANGAVMLALLQPGDTVLGMSLDAGGHLTHGARPALSGKWFNAVQYGVSREDSRIDYDEIEKLAVECQPKMIIAGGSAIPRQIDFARFREIADKVGAYLFVDMAHIAGLVATGAHPSPLPHAHVVTTTTHKTLRGPRGGMILSNDLDLGKKINSAVFPGLQGGPLMHVIAAKAVAFGEALQPEFKTYIDRVVENAKVLAGVMVERGCDIVTGGTDTHLMLVDLRPKGLKGNAADEALERAGITCNKNGIPFDPEKPMVTSGIRLGTPAGTSRGFGPEEFRLIGNLISDVLDGLVANPEDNSKVEAEVRAQVEELCKKFPLYR

SEQ ID NO: 27399 - protein, 423 aa, Aspergillus niger
MGDVAVETPANNVTPLTKAAPLDTIPNIDSLEGTGNDGSDEYATLKRLQRHLEYIQLQEEYIKDEQRSLKRELVRAQEEIKRIQSVPLVIGQFMEAIDQNTGIVQSSTGSNYVVRILSTLDREKLKPSSSVALHRHSNALVDILPPEADSSIAMLGENEKPDVTYADVGGLDMQKQEIREAVELPLTQFDLYKQIGIDPPRGVLLYGPPGTGKTMLVKAVANSTTASFIRVNGSEFVQKYLGEGPRMVRDVFRMARENSPAIIFIDEIDAIATKRFDAQTGADREVQRILLELLNQMDGFEQSSNVKVIMATNRADTLDPALLRPGRLDRKIEFPSLRDRRERRLIFSTIASKMSLSPEVDLDSLIVRNEPLSGAVIAAIMQEAGLRAVRKNRYNIIPRSDLEDAYAAQVKTGQEADRLEFYR

SEQ ID NO: 27400 - protein, 324 aa, Brucella melitensis
MTQRHAPVIVIGSGPAGYTAAIYAARAMLKPVVIAGLQQGGQLMITTDVENYPGYAEPVQGPWMMEQMARQAENVGAQIVHDIITEVETTVRPFRLKGDSGTIYTCDALIIATGAQAKWLGLESEQTFMGGGVSACATCDGFFYRGKDVVVVGGGNTAVEEALYLSHIAKSVTIVHRRDGFRAEKIMQDRLLSRENVSVVWNSVIDEILGTEARPPMGATVTGVRLKNIVTGETQERATHGVFIAIGHAPAVSLFEGKLKQKPNGYLWTAPDSTATDVPGIFAAGDVTDDIYRQAVTAAGMGCMAALEAERWLAAQEPLHEAAE

SEQ ID NO: 27401 - protein, 582 aa, Pyrus communis
MFRALAIGLLVLCFVTLVSGSDHDFGTCNCDEEGFWNLHIGECDKVSDFLIAIAYFSIPIELLYFVSCSNVPFKWVLLQFIAFIVLCGLTHLLNAWTYYGRYTFHEMLSLTIAKFLTALVSCATAITLLTLFPMILKVKVRELFLRQNVMELDQEVGMMKIQKEASWHVRMLTQEIRKSLDKHTILYTTLVELSKTLDLQNCAVWMPNEKRGEMNLTHELKTSSSRQYRRSIPINDPDVLEIRESERVMILRPDSALGSASSGESSESGAVAAIRMPMLRVSNFKGGTPQLVDTHYAILVLVLPVADSGGWSHHELEIVEVVADQVAVALSHAAVLEESQLMREKLAEQNRALQQAKKNAMMASQARHSFQKAMSHGMRRPMHMILGLLSMFQENLSFKQSIIVDTMEKTSYVICTLINDVMEMSAKDNERFPLEMRPFELHSMIKEAACLAKCLCMYKGFSFEIDVQSSLPNQVIGDEKRTFQVLLHMIGYLLSTYNGGGTVIFQAISVSGTDGPDDRLQGMWRIGIPDEYICIKFEFEINEANSYPGGLVASTHDARRQHNNDAIKKGLSFSICKKIVQV

SEQ ID NO: 27402 - protein, 967 aa, Unknown
  Oceanospirillum sp. MED92
MAVETRTLSDLQQANEFTHRHIGPDAEQTQEMLSYLGVDSVEDLMTQTVPDSIRLDDALDMTDSVSEADALAYLKQLAAKNKVNKSYLGMGYSNTLVPNVILRNVMENPGWYTAYTPYQPEIAQGRLEALLNFQQMVMDLTGMELANASLLDESTAAAEAMTLCKRSNRKKSNTFFVADDVHPQTIDVIKTRAEYFGYDIVVGNPLTDLEAADPFGVQLQYPSTYGDITDIKSVIDAAHGQKAMVSVAADILALVLLKSPGELGADIVLGSSQRFGVPMGFGGPHAAFFAASEKLKRSVPGRIIGVSIDVNGNQALRMAMQTREQHIRREKATSNICTAQALLANMASFYVVYHGPEGLKRIAERVHRLTAILANGLKAKGVQVNDTYFDTLTVTLPETQEVVYQRALEEGCNLRKIGSDKLGISLDETTLPADVAVLLDVILGDAHGQTVEALDAAIVAGEATGISADARREDAILTHPTFNSYHSETDMLRYMKKLENKDYSLVHGMIPLGSCTMKLNATAEMIPVTWPEFANIHPFAPADQVAGYHQMLNELEEQLVEITGYDKVSLQPNSGASGEYAGLLAIRKYQESIGEGHRNVCLIPSSAHGTNPASAAMMDMKIIVTKCDDNGNVDVADLRAQAELHKDDLSCLMITYPSTHGVYEEDIVEICDIIHKNGGQVYMDGANMNAQVGISKPGLIGSDVSHLNLHKTFAIPHGGGGPGMGPIGVKSHLAPFLASHKVSPVEGLNPENGAVAAAPYGSASILPITWMYNVMLGKSGLKASTQMAILNANYMTEKLAEHYPVLYRGRNNKVAHECIVDIRPLKEESGVTEEDIAKRLMDYGFHAPTMSFPVAGTLMIEPTESESKVEIDRFVDAMVQIREEIAKVQNGEWPADNNPLFNAPHTQADVMNGAWDRPYTREEAVFPNEATRTNKFWPMTNRIDNVYGDRNFICSCPGIEAYQDQEG

SEQ ID NO: 27403 - protein, 553 aa, Mannheimia succiniciproducens
MYCVQCEQTMVTPKGNGCSFSQGMCGKTAETSDLQDLLIATLHSLSAWALKAREHNIIIHEADAFAPRAFFATLTNVNFDSARIAGYAQQALIYRNQLIKAVNEVEPNPNIDHPLANIELNGISVEQLALQAKQFALDTDRQQIGEEAHGVRLLCLYGLKGAAAYMEHAYVLDKFDNDIYAEYHGFMSWLGTQPGDLNELLEKALAIGSMNFKVMAMLDAGETEHFGNPVPAMVNVRPVKGKCILISGHDLKDLKELLEQTEGKGINVYTHGEMLPAHGYPELKKYKHLVGNFGSGWQNQQKEFARFPGAIVMTSNCLIDPNVGDYADRIFTRNIVGWPGVTHLEDHDFSPVIEKALQCDGFPYTELEHLITVGFGRKTLIDASDAVIDLVKAGKLSHVFVIGGCDGDKEERHYYTDLAYALPKDTAVLTLGCGKYRFNKLDFGTIDGGLPRLLDAGQCNDTYSAIMLAVTLSQKLGIGLNELPLSIVLSWFEQKAIIVLLTLLALGVKNVYSGPSKPAFLNDNVMALLHEKFGLSGLTTPEQDFGHIINKNL

SEQ ID NO: 27404 - protein, 275 aa, Thermococcus kodakarensis
MPRKAKEYPEEGEFVVATVKNIHPYGAFLTLDEYPGKEGFMHISEVAPTWVKNIRDYLKEGQKIVAKVIRVDPEKGHIDLSLKRVNQQQRKAKLQEYKRAQKAENLLKMAAEKLGKDFETAWREVWVPLEEEYGEVYAAFEDAAQNGMDVLKGLISDEWIEALKPIIEAYVEIPTVTIDAEFEITVPKPNGIEIIKEALIKARDRANQEKDIEVKFSYQGAPRYRIDITAPDYYKAEEVLEDIAEEILRVIKEAGGEATLIRKEKRIKKVKKRGS

SEQ ID NO: 27405 - protein, 420 aa, Streptococcus pyogenes
MTMIFDKGNVEDFDKELWDAIHAEEERQEHHIELIASENMVSKAVMAAQGSVLTNKYAEGYPGNRYYGGTECVDIVETLAIERAKKLFGAAFANVQAHSGSQANAAAYMALIEAGDTVLGMDLAAGGHLTHGSPVNFSGKTYHFVSYSVDADTEMLNYEAILEQAKAVQPKLIVAGASAYSRSIDFEKFRAIADHVGAYLMVDMAHIAGLVAAGVHPSPVPYAHIVTSTTHKTLRGPRGGLILTNDEALAKKINSAVFPGLQGGPLEHVIAAKAVAFKEALDPAFKDYAQAIIDNTAAMAAVFAQDDRFRLISGGTDNHVFLVDVTKVIANGKLAQNLLDEVNITLNKNAIPFETLSPFKTSGIRIGCAAITSRGMGVKESQTIARLIIKALVNHDQETILEEVRQEVRQLTDAFPLYKK

SEQ ID NO: 27406 - protein, 447 aa, Oceanobacillus iheyensis
MSKKIIIVGGVGGGATVAAQIRRTNKTAEILVLERNGYVSFANCGMPYYLGGTITDRQKLIYPEEKFAQKYDLTVQTHANVTKINREQKSVVYEKYKTEHKADYDILILSPGASPVLPDIAGLQQSNTFPLRTIEDMDNIEQFIQSNNPQSAAIIGGGFIGLEMAESLCHRGFSCSLVDRSEHVLKRIDKEMAIHIDEHLQEKGIALYVNDGLKSFSDNGTTLHLSSDKTIQADMTIMAIGIKPNTELAIDAGLEIGETGGIKVNQYMQTTDPTIFALGDAVEVTDFITREPAHIALAWPAHRQAFIISSFLSGNPISDDGIIGSSILRVFDLTVAATGQNKQTLIDNEIAFEETIMKGYSHAAYYPGSKELWMQIVYDKNTGQLFGGSVIGFDGADKRMAVLATAIKGKLTVADLASLELGYSPIYSGAKDPLNILGYKAMEQLED

SEQ ID NO: 27407 - protein, 301 aa, Alkalilimnicola ehrlichei
MTERGGRILVLGTGRIGKAMAHLLGRRQPVVSWEGLPPDGSAPEPLEPLVHQAEFVFFCMPVVAHSDIAPRVAAALPDGAVCVTIAKGLDESGRTAAGILHQALGEGKALAAIYGPMIAEDLQADRLGFADLACPQRETFQQVRELFRGSALKLVHTTDLTGASWAVVLKNVYVPLIGAADELQLGDNVRGALTIDAFRELAAIVEALGGAPTSPYGLAGLGDFVGSATSADSHHRQLGRRLARGETRGLEGEGPHTLAMIDRHRLFDTEPYPLLNLARRMFADPPATADELRGYLEGWGE

SEQ ID NO: 27408 - protein, 607 aa, Bacillus anthracis
MCGITGWVDWKEDLSNQHVILKKMANRIQHRGPDAEGFWFSPRAAFAHRRLIVIDPEGGAQPKTFRAGDYTYALTYNGEIYNFRELREQLQKCGHTFETHSDTEVLLHAYLEWKEDCVQHLNGIFAFALWDDQKQRLFLARDHLGVKPLFYTERNDSIIFGSEIKALLAHPSVPAEIDADGINEIFGLGLFRTPGCGVFKHIEEVRAGHSITFTRDKKVVTKYWNLESKVHTDSIEDTSSHILSILQDTVKRQLIADVPLVCMLSGGLDSSGITALAGKEFAAENKTLHTYSVDFVNSAKDFELTFARTGLDAPWVKRVSEHVGTSHHDIIVNAEELANHLFVPLRAKDLPSAGEMETSLYLLFCEMKKDATVALSGESADEVFGGYPWFHQEELLYVDKFPWLTNWKNTSPLLLHEISNQCNLENYIDTRFQEAILEVPTLEGESKKSAKQRQMFYLFLTRFLPFLLDRKDRMSMAVGFEVRVPFCDYRLVEYLWNVPFNIKSIDNIEKGILRRALKPALPDDVRNRRKSAYPTSQDPQYLQTIRHLSLDMCSNKNNPIFSLINHSTLLAIADGSNKEINNFEARSAMEYMLQVNEWLKTYHIHIA

SEQ ID NO: 27409 - protein, 332 aa, Alkalilimnicola ehrlichei
MNRPLGIIGAGAWGTALAIAAGHAGHPVRLWGRDTAAVQAMARDRVNRRNLPDCPLPDPVQPQPDLTALVAECDDLLLVVPSRAFESMLHTLAPLIERRHRLGWATKGLDAASGGLLSQVVQRVLKPLPPLAVLSGPSFAAEVGRGLPTAVTVAATDQGFASDLADAFRYERFRVYTSTDLVGVQLGGAVKNVLAIATGVADGLGFGANARAALITRGLAETRRLSEALGADPDTLTGLAGMGDLILTCTDDQSRNRRLGLALGRGEDLDEAVEAIGTVEGVRTADELHRLATQAGVEMPICEQVHLRLAGRVSTREAVENLLLRPGGRQEQ

SEQ ID NO: 27410 - protein, 289 aa, Legionella pneumophila
MSDYLDKTASLTPAIKRIVCDKATEYPHTGSYNQVATHGTYLCRRCGLALFRGVSQFSSGCGWPSFDDEIANAVARKPDADGQRTEILCARCDAHLGHVFTGEYMTYKNLRHCVNSASLDFVADNEVLDTEEAILAGGCFWGVEYYLKRTPGVLKVESGYTGGHVSEPSYEQVCSGTSGHYEAVRVVYDAAKTNYHDIVKRFFEIHDPTQTNGQGPDLGHQYLSAVFYFNQEQRQEAELLIQLLKKRGYQVVTQLLQAQPFWPAEDYHQDYYFKHHKIPYCHKSVDRFG

SEQ ID NO: 27411 - protein, 363 aa, Myxococcus xanthus
MSSREEGRTSGTPAGHISVVHLPNAWFILCASSELGDKPLARTLQGSPLVLFRGEGGKPAALVDRCPHRNVPLSLGRVKEGQLQCGYHGWRFDGAGQCRAIPGFLGEPGARARCATAHATREQDGFVWVYSTPGVEPTTEPYRFPLLEAREYTTVRRTLRAPGSLHSTLENTLDVPHTAYLHGGLFRTEEKRNEIDVVVRRSADKVEAEYIGEPRPSGLVGRLLAPGGGVVQHFDRFLMPSIAQVEYRIGDTSHIMVTSAMTPVSDWDTLVYAVVTFRLPLPRWLVRAALPLLMPVALHIFGQDARILRQQTETIRRFGTEAYASTEIDVLGPGILRLLRAAEREKPGAVGDAVHETRLKMRT

SEQ ID NO: 27412 - protein, 546 aa, Yarrowia lipolytica
MQLLTAQKIDGHRHIITGQSNLAFSRAQRSLECGAQPIYVGTQLPEALKDLVKTGKVEHVDESFQFRHVTSLGRDEVSGVVDQVLVVGVHQHEEVDLGSLYRQCLSLRVPLNVAGHPEYCSFTFLASYADGDFQFGVTTSGKGCRLANRLKREMVAALPANVDEICNKIGSLRERIYEEDLKDVFEAEDIGQEDDDAEQKRLNVLVVEDSETFIQKKKQRLRWLSQLVEYFPLGKLANVSIDDLNRAYHSSQEADAKESQQNGQEDDSAPAVVDSSSSSSKAHIALIGSGPGSAQYLTSAALERINSADLILADKLVPESVLDLIPRATEVFIAKKYPGNAEAAQTELLERGLDGLKQGKMVVRLKQGDPYIYGRGGEEYIFFAGHGYKPEVVPGITSALSAPLAANIPPTHRDVADQVLICTGTGRKGAMPVIPEFVKSRTVIFLMALHRVDRLMEAISATPGWDLSTPCAVIERASCHDQRVTRTTLQYLVEAVEAIGSRPPGLLVVGHSCTILEKLDEGQKWKIEEGYHTGVGETLKGFSALA

SEQ ID NO: 27413 - protein, 423 aa, Legionella pneumophila
MSIFRSVLITLLFISSAMAATPDQVTYLPGWGPIKNNQYAGYFPVNPKAGLFYWFVESNNPSMDAPIVLWLNGGPGAASLYGFFMENGPYQVDKNGKLTARKDSWTKAANYLVIDQPAGVGYSYGSSKSYGSEGEAIDQLQGALQLIFKKHPELYGKPLFLAGESYAGKYLPQLAIRLLKDKNMNLKGLLLGDPWINPRLQQKANIDYAYYHGLIDNKARKRVRVLYENCVKEIDKQSPSTSKANKTCEQIQEFIKQESGGLNLANIATGVEPEDTNMVNYLNQKVVREALHIPVTVSEFKTFSTAAAKKLEIGEQDSVADLYPQLLAAGIRILIYNGLEDGKDSNFLSTELLLASLDWHGKNAFAKAPTCIWRTNNEVSGYAKGAVGLTQVKIRGAGHLAPIDQPARVFDLFKHFINDKPLC

SEQ ID NO: 27414 - protein, 449 aa, Oryza sativa
MAKRSSPDPASSSPSASSSPSSPSSSSSEDSSSPMSMPCKRRARPRTDKSTGKAKRPKKESKEVVDPSSNGGGGGGGGKRSSIYRGVTRHRWTGRFEAHLWDKNCSTSLQNKKKGRQVYLGAYDSEEAAARAYDLAALKYWGPETVLNFPLEEYEKERSEMEGVSREEYLASLRRRSSGFSRGVSKYRGVARHHHNGRWEARIGRVLGNKYLYLGTFDTQEEAAKAYDLAAIEYRGANAVTNFDISCYLDQPQLLAQLQQEPQLLAQLQQELQVVPALHEEPQDDDRSENAVQELSSSEANTSSDNNEPLAADDSAECMNEPLPIVDGIEESLWSPCLDYELDTMPGAYFSNSMNFSEWFNDEAFEGGMEYLFEGCSSITEGGNSMDNSGVTEYNLFEECNMLEKDISDFLDKDISDFLDKDISISDRERISPQANNISCPQKMISVCN

SEQ ID NO: 27415 - protein, 1564 aa, Arabidopsis thaliana
MAKSSADDEELRRACEAAIEGTKQSIVMSIRVAKSRGVWGKSGKLGRQMAKPRVLALSVKSKGPRKKAILRVMKYSSGGVLEPAKMYDLKHLSKVEVITSDPSGCTFTLGFDNLRSQSVAPPQWTMRNTDDRNRLLVCILNICKDVLGRLPKVVGIDIVEMALWAKDNTPVVTTQRSTEDGEPVAESVTESALKVTVEKELVSQAEEEDMEALLGTYVIGIGEAEAFSERLKRELQALEAANVHAILESEPLVDEVLNGLEAATNIVDDMDEWLGIFNIKLRHMREDIESIEIRNNKLEMQSVNNKALIEELDKVIERLRVPSEYAASLTGGSFDEADMLQNIEACEWLAKALRGLEVPNLDPIYANMRAVKEKRAELEKLKATFVRRASEFLRDYFASLVDFKFSDKSYFSQLKRPDHADLRYKCRTYARLMQHLKGLNKNCLGPLRKAYCSSLNLLLRREAREFAKELRASTKVSRNPTVWLEGSTGSSQNANTDTSAVSDAYAKMLTIFIPLLVDEVPALAPPGGAGNDKKSQSNNDDGNDNDDLGIMDIDEADKKPGKNSPDLTALNESLQDLLDGIQEDFYAVVDWAYKIDPLRSISMHGITERYLSGQKADAAGFVRLLLGDLESRISMQFSHVSILFVTLEKIAQQDPKYADILLLENYAAFQTCLFDLANVVPTLAKFYDQAMEAYEQACTRHISMIIYYQFERLFLFDKKIKDLMYTITPEEIPFQLGLSKVELRKMLKSSLSGVDKSIAAMYKKLQKNLASEELLPSLWDKCKKEFLDKYESFVQLVAKVYPSENVPGVTEMRGLLASIETRGRMRLEVEERLLFFSLKFLGFEYYDSSSVKNIVLTRYQSEDDSRSSTMETRAQARKEKEVMEDPLGLRMEKLENKIAEQNQKLDKSFAQLIDTIRLISVKVNNASSSGHLQQQRSRETVYPSSEVFHVRRTGTNSNYSAVTRSSKLDFHRFSGDRVRDWLFKLEQFFSLDFTPEELKVSIASTLCDGAAAKWYKSLFESDFGVKLLSNWNMYKLLLEEHFAEVLDDPISELKQLKETNGIEEYHKKFELLRARVNLSEDYLVRVYLDGLHPDTQMNVNMFQPQTVCQCLLVGRLYEQVHQKILIIRKVGEDSEKGAPTLNVPNEVAGPSLSNIHVHDALHKDRECFEGKHSIQGTTAGMENFMQQEELNCDRDCVFERDHWCAPYVNLETKLVNQEKSELCTGNEGEVKGCLEVSRQKVSSTFADLDKDDATTSQLRSPFGFVVDDLPSGCGSDNIRFRNSASPLVVGDSQKTPWILNEESNDIQNFQIAIDGSSNFYAGQESNGMRLRSHILTQQKRPSKSPKSWKFKFKISNDSKLRYIKFWCEKKRLMTLQFMGKIAVDMATYEDVYVSSFKKSHRCRKRAMIIVVDLSFDLGVTDGYIGELAFGQVNYFDREEFVKKLQAELDISVREEINQSWYLRISRKEAEEKCYTYLQWAKRSSGTKRAKDFHGRANGDDEECLWAEDWCFKYKTEMEMKGKLWGDKKFQKRLICHFRQPTEYSFSQPWGHGCLGGKDLIWEEE

SEQ ID NO: 27416 - protein, 507 aa, Zea mays
  misc_feature (423)..(423): Xaa can be any naturally occurring amino acid
MGAMMASITSELLFFLPFILLALLALYTTTVAKCHGTHPWRRQKKKRPNLPPGARGWPLVGETFGYLRAHPATSVGRFMERHVARYGKIYRSSLFGERTVVSADAGLNRYILQNEGRLFECSYPRSIGGILGKWSMLVLVGDAHREMRAISLNFLSSVRLRAVLLPEVERHTLLVLRSWPPSDGTFSAQHEAKKFTFNLMAKNIMSMDPGEEETERLRLEYITFMKGVVSAPLNFPGTAYWKALKSRASILGVIERKMEDRLEKMSREKSSVEEDDLLGWALKQSNLSKEQILDLLLSLLFAGHETSSMALALAIFFLEGCPKAVQELREEHLLIARRQRLRGASKLSWEDYKEMVFTQCVINETLRLGNVVRFLHRKVIRDVHYNGYDIPRGWKILPVLAAVHLDSSLYEDPSRFNPWRWKXSNNAPSSFMPYGGGPRLCAGSELAKLEMAIFLHHLVLNFRWELAEPDQAFVYPFVDFPKGLPIRVQRVADDQGHRSVLTESTRG

SEQ ID NO: 27417 - protein, 126 aa, Oryza australiensis
MSERRRREKLNEMFLILKSVVPSIHKVDKASILAETIAYLKELEKRVEELESSNQPSPCPLETRRRKSREITGKKVSAVAKRKASTPEVASDDDTDGVHHCVSNVNVTIMDNEVLLELQCQWKELL

SEQ ID NO: 27418 - protein, 1646 aa, Ostreococcus tauri
MPSGELLGCALACFGAWRIASARPRYPKRRGVYSIRRRGRSGEAVWHDADAADVFHCEPFDGCGTVHEVFEYATKKNGPRPALGEREVLETRGEIAADGRAVEKLRLGAYRWMTFREASDRVRAIASGLVDLAGLKEGDKVIIYADTKRDWQLAAQACFRMNLTVVTIYATLGEEGVKHGINQTGASVVVCDGKLLKTLTNVIGDCPSLKHVVTMGDPDAAQLDKLQNARVFQVSLDEVANVGAKKPLAARPPKPTDVAVLMYTSGTTGAPKGVMLTHANVCATMSGRLPRLSAVAHIMEMAAETLMLALGAAIARSGHSRRRAHFEPNVYVFAPPVLDRVPKPSRPSSAPAKPALKRLINAVLPAGRKDFENAKIGAPFLYNAIIFKKVQKLIGVRVRVMISGSAPLSRETQIFRQTCFRCPVRQGYGLTETGSCGTIAAFDDYSPTVGGVLSSVRISLRDWEEGGYRVSDENNPSIGLPRGEVLIGGPVVCQGYFNPKNMFDAELEEKNKKEFSEIDGVRYFHTGDIGQFTPDGQLQIIDRKKDLVKLQQGEYVALSKVENVLKQCPYVAMAMTYANSNHSYCIAIVVCNEAPLKKLAASKGIKGDLEAMCADKAIVDEISKACKDACKAGKLVGFETPTKQRHGHRRVQTQASKHHRRLQVSNHRHVHVAPLRLQQFLDFIAPRPPRSRVCTHRRPRIIDHTLASRAEMSTTSDDVLTERDARTFSESLAKSLGIFATIPRPIAEAHMRLRGYDAPPSSVSDAEVRGALLKALSDEVLLEREAKLRGEAFDPYVNARGRPQARRTQETAERRRCDRSNSRETKGKALGARSDSDDEDSESGSSVGGAYKPRDVASASEEETSEEEYGDASGPSDDDYNYCDDEEAEADDDGNYFGRAEMEPPAPDGANPFASIDFDLGEEARVQIEEAKRVCAARDARANDLSDAFTSLRATTGSEVSPAVSGRVAFSDKDDVASIAGSIAASDVTDRFDAVSLASVAATLGSDATDRVADVDSFYDDLRSLAGRAEVIYESGSGSDGGFPGTDSDEDHATQKENAPPTPRVRPRARVRPRARVKPSRCSRRGAMSVASTSAAAKGRTLVWFRKALRVHDNPALSRGTLHATACQPVFVLDPWFCQPSRVGANRMRFLLQSLRDLDAQLRARGSSLLVLHGEPRVVLPRACKKWRVDSVTWEHDIEPYAKIRDAAVRGALERAGVECHAASGHTLYDVDEMLEKCKGAPPTTYQGFFKIVDKMGAPNAPIDAMEKMPGSFASSDEETKALVQGVADAYGIPTLEDLGYEPLGDDEGFPGVGGETEGLRRLRLMLARKEWIGQFEKPSTNPTTRFHGLSQSGKTKPKSPFEIAAGRSKDGDASTSGAEALMIPSTTALSPYMKFGCVSPRVFYHELTAVYKELEGKHSKPPTSLMGQLMWREFYYLVAAGTKNFDKMEGNAICRQIPWKKDRELFAAWENAQTGFPWIDAAMTQLRREGWLHHLARHAVACFLTRGDLFIHWEWGRDAFDRDLVDADWALNNGNWMWLSCSAFFYQYFRVYSPIAFAKKYDKDGQYVRHYLPVLKNMPSKYVYEPWLAPLDVQKKAGCVVGVDYPAPIVDHSAASKRCVDDIATAYAAHKDANAVAGKKRKASD

SEQ ID NO: 27419 - protein, 492 aa, Glycine max
IRLEKLKKATLESAARRLGGGKEAMKQLLKLILEWVQTSHLQNKRRKENNGSSISSVLQAQFQDPSGQNNNQNTQSGSFAPESNTCFNNQTPWLSSQTFATDQAPLMVPPQQFPQPMVGYVGDPYTSGAASNNISATHNHNNSNPYQPGAEQYHMLESAHSWPHSLFNVASNYSQSFGDNNGLNPHGGFGGGGYGNNQYPYQFFHGPGDRLMRLGPSATKEARKKRMARQRRFLSHHRHHSGNHQNQGSDPHARMGGDNCNTALAAPHHANPSANWMYWQAMIGGAAGPLAPVIPAEPPVVQPVVDRSAMQTQNCHQNRVASDRRQGWKPEKNLRFLLQKVLKQSDVGSLGRIVLPKKEAETHLPELEARDGISITMEDIGTSRVWNMRYRYWPNNKSRMYLLENTGDFVRANGLQEGDFIVIYSDVKCGKYMIRGVKVRQQGVKPETKKAGKSQKNQHGTGTNASSTAGTAANNGTSSSPKTKSEKSSKLI

SEQ ID NO: 27420 - protein, 125 aa, Oryza eichingeri
MSERRRREKLNEMFLILKSVVPSIHKVAKASILAEPIAYLKELEKRVEELESSSQPSPCPLETRRRKCREITGKKVSAGAKRKASPEVASDDDTDGVHHCVSNVNVTIMDNEVLLELQCQWKELL

SEQ ID NO: 27421 - protein, 659 aa, Candida albicans
MSEQVKINPDLSIILVGSVINKCISEYKGDYKDCKALFPVNKFILDLNNLTQEYTTKFPNIDIHFPQIDIKLLSFIITKTLYHKFVTVTQDHVIIDVLPHAYENYLKNIVATSTLRYAKYLLKSAKDLYELEQKKLRKEKGGVSLQGNAPKETIPTLQQQSATPNEKQEVVVPPQVKAQPPNSTNTLKVNVAENKVDTIKESKPISNVPEPTKVQPKPQNSDNKDSTVSEKPSPNESTSLLVTKEKSEEKVVDEDQTMESSEDQKNEEQDLEESKELSNTDTDKMDIDEPQKPIDDKTSEKVEEEINQDQDQEMSDEGEEESAGVEEQPKTLESTTEPSDEEKVAENENGVEVPSDESKQDEVALEEKQTDEEAEKPIESIEENDEKNKESVIIEEDKEEEISKTKESEQEQEDKDEEREIGRTEQDESDEKVEETGKTEEETNKEEDAHQPSSPEEESPSIEEIPLKHESDADIEAIPGSDSSKEATPEVKQSPKISDDQGSQESPEKSHDDVPSPPPPPSTSSSASRKRARSRSPLPVPAQQHKRFQNIAINLLNSIQEHRFSSPFLQPVSVKDAPDYYNVVREPRDLKNIMKAVKSKNEPPLYQSVKELERDIMLMFANCIMYNQSGDDLVELTKTMKQDISEVFKMFEEAEEDIK

SEQ ID NO: 27422 - protein, 294 aa, Yersinia pestis
MTKVTVAATQMACSWDLPKNIENAEKLVRQAHAKGAQIILIQELFAAPYFCIDQSPEHYALAQELDNSPLIKHFSKLAAELEVVLPLSFFEKANNAYYNSLVMIDADGSVLDVYRKTHIPNGPAYQEKQFFIPGDTGFKVWQTRYAKVGVGICWDQWFPETARSLALLGAEVIFYPTAIGSEPAYPEIDSQPHWTRVQQGHAAANLVPVIASNRIGTEKSKYIDGLEMTFYGSSFIADQTGALLAQANKTDEAVLVHEFDLQEIAAQRASWGLFRDRRPEMYQTLATSDGKTRR

SEQ ID NO: 27423 - protein, 558 aa, Metallosphaera hakonensis
  misc_feature (416)..(416): Xaa can be any naturally occurring amino acid
MFGANSGKNGTIFSLWAPYCSWVNLKIGDERIPMKKDERGYFLVEVDVTPGTKYKFETDKGEIPDPASRFQPEGVHGPSQVIPTDFSWEDHDWKGLNKNQLIIYELHVGTFSSSWTFDGVVEKLDYLSDLGVTALEIMPVAQFPGIRGWGYDGVYLYAVQNSYGGPTGLKRLVNEAHKRQLGIILDVVYNHVGPEGNYMGLLGPYFSSKYKTPWGLTFNYDDRGSDEVRRFVLENLEYWIKEFHIDGFRLDAVHAIVDTSPTHILEEIADLAHAHGKLVIAESDLNDPRIVNPKEKCGYGVDAQWVDDFHHAIHAFITGERQGYYSDFGELQDIVKSLRDTFVYDGKFSRFRGKTHGKPVYLDGCSFVVYIQNHDQVGNRGGGERLSVLVDEERLKMAASLYILSPYIPMIWMGEXYGERNPFYYFSNFSDPELVRGVREGRKRENGQQTDPQSEETFKSSRLSWNVNQEILSVYKTLIKLRKEYVDCKRDAEVNSGDMWMTVNKGKLLTVFSFKPSVIAIKGRGKLVMGSKSFPREITGETRFEEGFGIYMREVEET

SEQ ID NO: 27424 - protein, 984 aa, Staphylococcus aureus
MQEHLVVTLDGKDYLVEPGTNLLEFIKSQDTFVPSICYNESMGPIQTCDTCTVEIDGKIERSCSTVIDRPMTVNTVNNDVKDAQKEALDRILEKHMLYCTVCDYNNGDCEIHNTMDAWGLQHQTYEYKEKPYEKDYGPFYRYDPNQCILCGRCVEACQDIEVNETIRIDWDREHPRVIWDNDVPINESSCVSCGQCATVCPCNAMMEVNMEGNAGYMTDTEPGSLAAMIDLTKKAEPGYGPLFAISDSEAEMRKERIKKTKTVCTYCGVGCSFEVWTKDREILKVQPSHDSPANKIATCVKGKFSWGHINSDQRLTKPLVRKNGEFHEVEWDEALNVIADNFTSIKEKYGPDALSFISSSKATNEESYLMQKLARQVIGTNNVDNCSRYCQAPATKGLFRTVGHGGDSGSIEDLEKAAMSVLIGTNTAEAHPVIASRMKRAQKLFGQKIHVFDIRKHEMAERADRFYQPKPGTDLAWLSAVTKYIIDHDLHDKAFIDEWVDDFDEYYKSLETFTMAFAEEATGIPESELIKFAEECAKAESVVICWAMGITQQDIGSDSSTAISNLLLVTGNYRRPGTGAYPLRGHNNVQGCSDMGSMPDKITGYQSIEADDIRAKFEKEYGVKLNPKAGKDNHEMVEGIHDGEVHSLYLYGEDTGIVDSNINFVQAAFEKLDFMVVQDEFLTFTATYADVVLPASPSLEKDGTFTNTERRIQRLYQALEPLGDSKPDWKIFQAIANRLGFDWNYKHPSEIMDEVARLTPLYAGVSYDRLEGFNSLQWPVQPDGTDEPILYLEGFNFDNGKAKLFPLSFDNYFKQDEIYDIHVNNGRLLEHFHEGNMTYQTPMIKYKVPRAFVEISPELAEDRGIHEGAEVKLISETGEAVLQVHVTDRVKGKEIYIPLNNDAMENGDLGAINLLTNSDVDQYTDTPSYKRTSCRLEVITKRGKSPLNPNNFRVNKKRHPQYSVQVQKKWERSDYVFPGNQVDK

SEQ ID NO: 27425 - protein, 112 aa, Methylococcus capsulatus
MKLITAIIKPFKLDDVREALSDIGVSGLTVTEVKGFGRQKGHTELYRGAEYVVDFLPKVKLEIAVADTLVDAAVDAIVKAANTGKIGDGKIFITSIDQAIRIRTGETGDQAL

SEQ ID NO: 27426 - protein, 680 aa, Thermotoga maritima
MGIGGDDSWSPSVSAEFLLLIVELSFVLFASDEFVKVENGKFALNGKEFRFIGSNNYYMHYKSNGMIDSVLESARDMGIKVLRIWGFLDGESYCRDKNTYMHPEPGVFGVPEGISNAQSGFERLDYTVAKAKELGIKLVIVLVNNWDDFGGMNQYVRWFGGTHHDDFYRDEKIKEEYKKYVSFLVNHVNTYTGVPYREEPTIMAWELANEPRCETDKSGNTLVEWVKEMSSYIKSLDPNHLVAVGDEGFFSNYEGFKPYGGEAEWAYNGWSGVDWKKLLSIETVDFGTFHLYPSHWGVSPENYAQWGAKWIEDHIKIAKEIGKPVVLEEYGIPKSAPVNRTAIYRLWNDLVYDLGGDGAMFWMLAGIGEGSDRDERGYYPDYDGFRIVNDDSPEAELIREYAKLFNTGEDIREDTCSFILPKDGMEIKKTVEVRAGVFDYSNTFEKLSVKVEDLVFENEIEHLGYGIYGFDLDTTRIPDGEHEMFLEGHFQGKTVKDSIKAKVVNEARYVLAEEVDFSSPEEVKNWWNSGTWQAEFGSPDIEWNGEVGNGALQLNVKLPGKSDWEEVRVARKFERLSECEILEYDIYIPNVEGLKGRLRPYAVLNPGWVKIGLDMNNANVESAEIITFGGKEYRRFHVRIEFDRTAGVKELHIGVVGDHLRYDGPIFIDNVRLYKRTGGM

SEQ ID NO: 27427 - protein, 666 aa, Thermotoga neapolitana
MRKLVFSFLIVTLPIVLFANSDFVKVENGRFILNGEEFRFVGSNNYYMHYKSNRMIDSVLESAKAMGVKVLRIWGFLDGESYCRDKNTYMHPAPGVFGLPEGTNAQDGFERLDYTVAKAKELGIKLIIVLVNNWDDFGGMNQYVRWFGGIHHDDFYRNEKIKEEYKKYVSFLINRVNTYTGVPYREEPTIMAWELANEPRCETDKSGNTLVEWVEEMSAYIKSLDPNHLVAVGDEGFFNNYEGFRPYGGEAEWAYNGWSGVDWKRLLEIETVDFGTFHLYPSHWGVSPENYAQWGAKWIEDHIKIAKEVGKPVVLEEYGIPKSAPVNRVAIYKLWNDLVYNLGGNGAMFWMLAGIGEGWDRDEKGYYPDYDGFRIVNDESEEAKLIREYAKLFSTGEDTREDTCMFITPKDGQEIKKTVKVRVGVFDYSNTFKGISVGVENLLFEDEIKHLGYGVYGFEFDTTRISDGEHEMFLEAHFRGETVKDTIRVKVVNRAQYVLAEEVDFSRPEEVKNWWNSGTWQAEFKTPDIEWNGEVGNGALQMNVVLPGKGDWEEVRVVRKFDQLPVCEILEYDIYIPDVEGLTGRLRPYAVLNPGWVKIGLDMNNTSIDSGELVSFDGKKYRKFHVRIEFDKTPGVNELHIGVVGDHLEYDGPIFIDNVRLYKKSS

SEQ ID NO: 27428 - protein, 355 aa, Canavalia lineata
MSLVSDLINLNLSESTEKIIAEYIWVGGSGMDLRSKARTLPGPVSDPSKLPKWNYDGSSTDQAPGDDSEVILYPQAIFKDPFRRGNNILVICDVYTPAGEPLPTNKRHDAAKIFTHPDVVAEEPWYGIEQEYTLLQKDVNWPLGWPLGGYPGPQGPYYCGVGADKAYGRDIVDAHYKACVYAGINISGINGEVMPGQWEFQVGPSVGISAGDELWAARYILERITEIAGAVVSFDPKPIPGDWNGAGAHTNYSTKSMRDEGGYEVIKKAIEKLGLKHKEHIAAYGKGNRRLTGRHETADINTFSWGVANRGSSIRVGRDTEKEGKGYFEDRRPASNMDPYVVTSMIAETTILWKP

SEQ ID NO: 27429 - protein, 126 aa, Zea mays
MPVAASLMAIELEKDQLAWAEQQRQQNRRQTMVVCRKSAAAVAKGQQRQNASPPSPKPPPAGGLSAEAFLVLACVAVSLIVLPLVLPPLPPPPPLLLLVPVCLLLLLAALATFMPSDVRSMPSSNL

SEQ ID NO: 27430 - protein, 1012 aa, Glycine max
MPKMRVLFVFLFFHFHFPETLSAPISEYRALLSLRSVITDATPPVLSSWNASIPYCSWLGVTCDNRRHVTALNLTGLDLSGTLSADVAHLPFLSNLSLAANKFSGPIPPSLSALSGLRYLNLSNNVFNETFPSELWRLQSLEVLDLYNNNMTGVLPLAVAQMQNLRHLHLGGNFFSGQIPPEYGRWQRLQYLAVSGNELDGTIPPEIGNLTSLRELYIGYYNTYTGGIPPEIGNLSELVRLDVAYCALSGEIPAALGKLQKLDTLFLQVNALSGSLTPELGNLKSLKSMDLSNNMLSGEIPASFGELKNITLLNLFRNKLHGAIPEFIGELPALEVVQLWENNLTGSIPEGLGKNGRLNLVDLSSNKLTGTLPPYLCSGNTLQTLITLGNFLFGPIPESLGTCESLTRIRMGENFLNGSIPKGLFGLPKLTQVELQDNYLSGEFPEVGSVAVNLGQITLSNNQLSGALSPSIGNFSSVQKLLLDGNMFTGRIPTQIGRLQQLSKIDFSGNKFSGPIAPEISQCKLLTFLDLSRNELSGDIPNEITGMRILNYLNLSKNHLVGSIPSSISSMQSLTSVDFSYNNLSGLVPGTGQFSYFNYTSFLGNPDLCGPYLGACKGGVANGAHQPHVKGLSSSLKLLLVVGLLLCSIAFAVAAIFKARSLKKASEARAWKLTAFQRLDFTVDDVLHCLKEDNIIGKGGAGIVYKGAMPNGDHVAVKRLPAMSRGSSHDHGFNAEIQTLGRIRHRHIVRLLGFCSNHETNLLVYEYMPNGSLGEVLHGKKGGHLHWDTRYKIAVEAAKGLCYLHHDCSPLIVHRDVKSNNILLDSNHEAHVADFGLAKFLQDSGTSECMSAIAGSYGYIAPEYAYTLKVDEKSDVYSFGVVLLELITGRKPVGEFGDGVDIVQWVRKMTDSNKEGVLKVLDPRLPSVPLHEVMHVFYVAMLCVEEQAVERPTMREVVQILTELPKPPGSKEGDLTITESSLSSSNALESPSSASKEDQNPPQSPPPDLLSI

SEQ ID NO: 27431 - protein, 1165 aa, Streptococcus pyogenes
MKKKVNQGSKRYQYLLKKWGIGFVIAATGTVMLGCTPSILTHQVAAKTIVGLARDEAQQGDGNAKSGDGFQSSSKEAKPVLDSSSANPASIAEHHLRMHFKTLPAGESLGSLGLWVWGDVDQPSKDWPNGAITMTKAKKDDYGYYLDVPLAAKHRQQVSYLINNKAGENLSKDQHISLLTPRMNEVWIDENYHAHAYRPLKKGYLRINYHNQSGHYDNLAVWTFKDVKTPTTDWPNGLDLSHKGPYGAYVDVPLKEGANEIGFLILDKSKTGDAIKVQPKDYLFKELDNHTQVFVKDTDPKVYNNPYYIDQVSLKGAEQTTPNEIKAIFTTLDGLDEDAVKQNIKITDKAGKTVAIDELTLDKDKSVMALKGDFKTQGAVYTVTFGEVSQVARQSWQLKDKLYAYDGELGATLAKDGSVDLALWSPSADTVKVVVYDKQDQTKVLGQADLTKSDKGVWRAHLTSDSIKGISDYTGYYYLYEITRGQEKVMVLDPYTKSLAAWNDATATDDIKTAKAAFIDPSKLGPTGLDFAKINNFKKREDAIIYEAHVRDFTSDKALEGKLTHPFGTFSAFVEQLDYLKDLGVTHVQLLPVLSYFYANELDKSRSTAYTSSDNNYNWGYDPQHYFALSGMYSANPNDPALRIAELKNLVNEIHKRGMGVIFDVVYNHTARTYLFEDLEPNYYHFMNADGTARESFGGGRLGTTHAMSRRILVDSITYLTREFKVDGFRFDMMGDHDAAAIEQAFKAAKAINPNTIMIGEGWRTYQGDEGKKEIAADQDWMKATNTVGVFSDDIRNTLKSGFPNEGTAAFITGGAKNLEGLFKTIKAQPSNFEADAPGDVVQYIAAHDNLTLHDVIAKSINKDPKVAEEEIHKRIRLGNTMILTAQGTAFIHSGQEYGRTKQLLNPDYKTKVSDDKVPNKATLIDAVAQYPYFIHDSYDSSDAVNHFDWAKATDSIAHPISNQTKAYTQGLIALRRSTDAFTKATKAEVDRDVTLITQAGQDGIQQEDLIMGYQTVASNGDRYAVFVNADNKTRKVVLPQAYRYLLGAQVLADAEQAGVTAIAKPKGVQFTKEGLTIDGLTALVLKVSSKTADPSQQKSQTDNHQTKTPDGSKDLDKSLMTRPKRAKTNQKLPKTGEASSKGLLAAGVALLLLAISLLMKRQKD

SEQ ID NO: 27432 - protein, 238 aa, Unknown
  Sulfitobacter sp. EE-36
MSGFVSFVSSGPGDPELLTVKAVKRLQEAEVVLFDDLSAGPILEHVSPEADLIGVGKRAGRLSPKQDHVSRLLVEHALTGARVVRLKSGDAGVFGRLEEELTALKAAGVAFEIIPGVTAASSAAAAAMIPLTRRLTARRVQFITGHGESGALPEDLNMAALADPTATTVVYMGRRTFAGFAARLIAAGLPPSTPALLAEAVSTPDQKLSRHTVESLAHLPLDPATSAPALILYGPLTE

SEQ ID NO: 27433 - protein, 537 aa, Streptococcus pyogenes
MKKHWWHKATIYQIYPRSFKDTNGNGIGDLKGITSQLDYLQKLGITAIWLSPVYQSPMDDNGYDISDYEAIADVFGDMADMDELLAAANERGIKIIMDLVVNHTSDEHAWFVEARENPNSPERDFYIWRDEPNDLTSIFSGSAWEYDNASGQYYLHLFSKRQPDLNWENEALRHKIYDMMNFWIAKGIGGFRMDVIDLIGKVPDSEITGNGPRLHDYLKEMNQATFGNHDVMTVGETWGATPEIARQYSRPENKELSMVFQFEHVGLQHKPDAPKWDYAKELDVPALKAIFSKWQTELKLGEGWNSLFWNNHDLPRVLSIWGNDSTYREKSAKALAILLHLMRGTPYIYQGEEIGMTNYPFKDLTEVNDIESLNYAKEAMGNGVSAARVMDSIRKVGRDNARTPMQWSKDTHAGFSKAQETWLPVNPNYQDINVADALADPDSIFYTYQKLIALRKEQDWLVEADYHLLPTADKVFAYQRQLGEETYVIVVNVSDEEQVFAKDLAGAQVIIANTDVDTVLETKHLQPWDAFCLKLKA

SEQ ID NO: 27434 - protein, 416 aa, Vibrio fischeri
MLKRDMNIADYDADLFAAIQEETVRQEEHIELIASENYTSPRVMEAQGSQLTNKYAEGYPGKRYYGGCEYVDKVETLAIERACELFGAEYANVQPHSGSQANNAVYMALLNAGDTVLGMSLAHGGHLTHGSPVNFSGKLYNIIPYGIDENGQIDYEEMEALAVEHKPKMIIGGFSAYSQVCDWARMREIADKVGAYFFVDMAHVAGLIAAGVYPNPVPHAHVVTTTTHKTLAGPRGGLILSNEGEDLYKKLNSAVFPGGQGGPLMHVIAGKAVAFKEALEPEFKEYQARVVANAKAMVAEFLARGYNIVSGSTENHLFLVDLIDKDITGKEADAALGSANITVNKNSVPNDPRSPFVTSGIRIGSPSITRRGFTEEDAKNLAGWMCDILDNMGDESVIEATKAKVLEICKRLPVYA

SEQ ID NO: 27435 - protein, 404 aa, Oryza sativa
MAAATTSRRGPGAMDDENLTFETSPGVEVISSFDQMGIRDDLLRGIYAYGFEKPSAIQQRAVLPIISGRDVIAQAQSGTGKTSMISLSVCQIVDTAVREVQALILSPTRELAAQTERVMLAIGDFINIQVHACIGGKSIGEDIRKLEHGVHVVSGTPGRVCDMIKRRTLRTRAIKLLILDEADEMLGRGFKDQIYDVYRYLPPELQVCLISATLPHEILEMTSKFMTDPVRILVKRDELTLEGIKQFFVAVEKEEWKFDTLCDLYDTLTITQAVIFCNTKRKVDWLTERMRSNNFTVSAMHGDMPQKERDAIMGEFRSGATRVLITTDVWARGLDVQQVSLVINYDLPNNRELYIHRIGRSGRFGRKGVAINFVKKEDIRILRDIEQYYSTQIDEMPMNVADLI

SEQ ID NO: 27436 - protein, 389 aa, Vibrio angustum
MTDAIRKFLKLESAGGIVLIIAALIAMIIANSPLASVYTDTLHSYVAGLSVSHWINDGLMAVFFLLIGLEVKRELIEGALNTKEKAIFPAIAAVGGMVAPALIYVAFNYNDPMAIKGWAIPAATDIAFALGVMALLGNRVPVSLKVFLLALAIIDDLGVIIIIALFYSSDLSTVALAVAFVATATLFIMNAKNVTKLSWYLIVGAILWFSVLQSGVHATLAGVILGFTIPLTGKDGRSDKHSPLKHLEHVLHPYVAFLILPIFAFANAGISLDGVSLESLSSMLPAGIAAGLFIGKPLGIFTACIIAVKCGFAKLPDDINFKHIFAVSVLCGIGFTMSIFISSLAFVGAGESFATYSRLGILLGSTVAAVVGYVLLSRSLPKEAQKVEA

SEQ ID NO: 27437 - protein, 615 aa, Nostoc punctiforme
MRIGANYLGNGECEFTVWSPLLDSVTVKTLTPQEQVIPLKPQSEGYWHAKVNDVYPGTLYRYVLNGQDAFADPASQYQPEGVHGPSQIVDHQFEWTDEEWTGIPVESMIFYELHVGTFTPEGTFTAIISRLPELRELGINAIEIMPIAQFPGDTHIEASLAYRNWGYDGVYPYAVQNSYGSPAELKQLVNACHQNNIAVVLDVVYNHFGPEGNYMSQFAPYFTKTYKTPWGEALNFDDAHSQGVRNYFIENALYWLREFHIDALRLDAIQAIYDLGAKHFLWELAEAVHHFSQQGQKWKRHLIAESDLNNPQIIRPAELGGYGLDAQWSDDFHHSLHALLTGDRQGYYQDFGQTAQLAKAYEDTFVYDWKYAPHRKRFHGISCRDRNLSQFAICIQNHDQIGNQMKGERLTQRISFEGLKLAAGAVLLSPNLPLLFMGEEYGETAPFIYFVSHSDPDLIQAVRAGRKQEFEAFHYADDPPDPESAETFLKSKLNWQLRHEGNHKVLWDWYRQLINLRKTHPALLNQDRNFIEATSDEDKQVVIVRRWCESSELIFVMNFNSSPVTVTLPFEQNANKLLDSADTSWSGVGSEADEHLSAGKEVKLQPTSLVLYEKA

SEQ ID NO: 27438 - protein, 460 aa, Alkalilimnicola ehrlichei
MPFIPHTEAEVRRMLEVIGVRHLDALFDEIPAALRAPPPQGVPEGLPEMAVRRIARRRAAQDRQPVSFLGAGCYEHHIPAAVWQIAARGEFYSAYTPYQAEASQGTLQVIYEFQSMLSALTGLAVSNASLYDGATATAEAALMAVRQRRRDAAHRVLVPHTLHPLYRRVLSTLLAPQGIELTLLDYDPDQGHLPEHALEGVSGGFDALLLPQPNFLGVLEPVDTLTRAAQARGALVIGVVNPIALARLAPPGEWGEAGADIACGEGQPLGIPMSSGGPGFGFLTCRRPLMRQLPGRLVGRTVDLDGKPGYTLTLQAREQHIRRGRATSNICTNQGLMATAATLYLALLGPDGLERVADCCLARTHALVEALTGLPGVQSALRGPHFHEAVLRLDRPVAPVLQALEDHGILGGHDLSADYPELGNALLVCATEMRDEVDIEYYRDSLAAVLNTRPDPVPSP

SEQ ID NO: 27439 - protein, 511 aa, Alkalilimnicola ehrlichei
MATGRAPRAPVLRPPPNRQETDPMLIFEQAREGRRAAAQAPERPTRVPALPEAFRRRKRPALPEVSELQAVRHYTRLSQLNFSIDTHFYPLGSCTMKYNPRGCHAVASEPGFAERHPLAPSTTGQGMMACLHELQDWLTAITGMGDTSLAAMAGAQGEFCGVAMIMAWHAGRGDHQRNEILVPDAAHGTNPATAALCGCTVREIPTGPDGDVDMGALHEALGPRTAGIMLTNPSTVGVFERRIREMADAVHAAGGLLYYDGANLNAILGRVRPGDMGFDVMHLNLHKTFSTPHGGGGPGAGAVCVSERLRPYLPVPQVAREPDGRFRWLQEGDRPHTIGRLSAFGGNIGVLLRAWAYTRMLGREGLPRVADYATLNANYLMARLQAEGFQVAYPERRASHEFVLTLKSEARELGVTALDFSKALLDHGIHAPTMYFPMLIPECLLIEPTETESLAELDAFVAAMVAIREAARRDPEQVRGAPYRLPVRRLDEVRAARQPDLAWRPEAAPDP

SEQ ID NO: 27440 - protein, 379 aa, Magnaporthe grisea
MQIFVKTLTGKTITLEVESSDTIDNVKSKIQDKEGIPPDQQRLIFAGKQLEDGRTLSDYNIQKESTLHLVLRLRGGMQIFVKTLTGKTITLEVESSDTIDNVKSKIQDKEGIPPDQQRLIFAGKQLEDGRTLSDYNIQKETTLHLVLRLRGGMQIFVKTLTGKTITLEVESSDTIDNVKSKIQDKEGIPPDQQRLIFAGKQLEDGRTLSDYNIQKESTLHLVLRGGMQIFVKTLTGKTITLEVESSDTIDNVKSKIQDKEGIPPDQQRLIFAGKQLEDGRTLSDYNIQKESTLHLVLRLRGGMQIFVKTLTGKTITLEVESSDTIDNVKSKIQDKEGIPPDQQRLIFAGKQLEDGRTLSDYNIQKESTLHLVLRLRGGQ

SEQ ID NO: 27441 - protein, 607 aa, Oryza sativa
  misc_feature (42)..(42): Xaa can be any naturally occurring amino acid
METHIGSVDGAAAAADNGAVGCPASAVGCPMTSARPAPVSAXGEASLGRHLARRLVQVGVSDVFAVPGDFNLTLLDHLIAEPGLRLVGCCNELNAGYAADGYARARGVGACAVTFTVGGLSVLNAIAGAYSENLPVICIAGGPNSNDYGTNRILHHTIGLPDFSQELRCFQTVTCHQAVVTNLEDAHEQIDTAIATALRESKPVYLSISCNLPGLPHPTFSRDPVPFFLAPRLSNKMGLEAAVEATVEFLNKAVKPVLVGGPKLRVAKAGKAFVDLVDASGYAYAVMPSAKGLVPETHPHFIGTYWGAVSTAFCAEIVESADAYLFAGPIFNDYSSVGYSFLLKKDKAIIVQPERVIVGNGPAFGCVMMKEFLSELAKRVNKNTTAYENYKRIFVPEGQPLESEPNEPLRVNVLFKHVQKMLNSDSAVIAETGDSWFNCQKLKLPEGCGYEFQMQYGSIGWSVGALLGYAQGAKDKRVIACIGDGSFQVTAQDVSTMIRCAQNSIIFLINNGGYTIEVEIHDGPYNVIKNWNYTGLVDAIHNGEGKCWTSKVKCEEELTEAIGMALGEKKDCLCFIEVIAHKDDTSKELLEWGSRVSAANSRPPNPQ

SEQ ID NO: 27442 - protein, 130 aa, Oryza longistaminata
MSERRRREKLNEMFLILKSVVPSIHKVDKASIFAETIAYLKELEKRVEELESSSQPSPCPLETRSRRKCREITGKKVSAGAKRKAPAPEVVASDGDTDGERRHCVSNVNVTIMDNKEVLLELQCQWKELL

SEQ ID NO: 27443 - protein, 243 aa, Zea mays
PKDVLYNVRTYVRTCRPTFIRIWKKGSVEQYSPIPYVATLLNCMMWVLYGLPLVHPHSMLVITINGTGMLIQLTYVALFLVYSAGAARRKVSLLLAAEVAFVGAVAALVLALAHTHERRSMVVGILCVLFGTGMYAAPLSVMKMVIQTKSVEYMPLFLSLASLVNGICWTAYALIRFDLYITIPNGLGVLFALAQLVLYAIYYKNTQKIVEARKRKAGQVAMTEVVVDGSRASNNNNGGSGTY

SEQ ID NO: 27444 - protein, 118 aa, Oryza longistaminata
MSERRRREKLNEMFLILKSLVPSIDKVDKASIPLEPIPSSKELKRRFQELESGKKLSSPPKRKPCSETIIGGGDAGAVKEHHHWVLSESQEGTPSDVRVIVMDEDELHLEVHCRWKEL

SEQ ID NO: 27445 - protein, 107 aa, Eremopyrum bonaepartis
MREKKNPREAKVTFEGLVTEALPNGMFRVRLENDTIILGYISGKIRSSSIRILMGDRVKIEVSRYDSSKGRMIYRLPHKDSKRIEDSKDNEDLKDSEDLKDTKDSKD

SEQ ID NO: 27446 - protein, 386 aa, Clostridium difficile
MKKEMLAMILAGGQGSRLGVFTKRIAKPAVSFGGKYRIIDFVLSNCSNSGIDTVGVLTQYRPLILNSHIGMGSHWDLDRINGGVYVLQPFMNEKEGNWYNGTAHAIYQNMDFVDTYNPEYVLILSGDHIYKMDYSKMLKFHKEKGSKATIAVIEVPWDEASRFGIMNTNEDSSIYEFEEKPSEPKSNLASMGVYIFDWKMLRNYFKEAEKNPEINYDDFGKNLIPKMLEDNVGMYAYPFKGYWRDVGTIQSLWDANMDIIKSPETLDLADPKWKIYTNTMAMPPQYIGKNANVHRSMIADGCRILGEVGNSVLSHGVVVGKGSKVIDSVIMPNVVIGENVTIEKAMIGECATINDNVQIKNVNNEINVVSEYENIEPRCVLIEGGL

SEQ ID NO: 27447 - protein, 126 aa, Oryza officinalis
MSERRRREKLNEMFLILKSVVPSIHKVDKASILAETIAYLKELEKRVEELESNNQLSPCALETRRRKCSEITGKKVSAGAKRKASAPEVASDDETDGERHCVSNVNVTIMDKEVLLVVQCQWKELL

SEQ ID NO: 27448 - protein, 489 aa, Candida albicans
MLIQSRFPLKALQQVSSKRFNSSSLNPTIKNQLSNPPPIGSIIEARGFVKSIRSSKKVGFVDITDGSISNNLNIVLQGPDQPKFKVGQSIVVKGDWTVGKGKQPFELKYNPENPQHAITILGDVTDDYPLQKKATSMSFLRNFPEIKHRTSTLGSFLRLRSHLEFKLMEFFQSRDFIKVTPPLITSSDCEGAGEVFKIEPLNDNNPKEPFFGKNAYLTVSTQLHLECLALALNRAWTLTPCFRAENSNTTRHLSEFWMLEAEISHVNNVDQVTTFTEDMIKFVTKSLVESSHSTELSDLGAGNGNDYLNGTYIEKDVVQSRWSNILSAERWPRMTYTEAIEYLNKTLPQDEQLIWGDSLQLKHERLLAEKSPIFITDYPESQKPFYMLKSANYNAENPTVACFDLLVPEFGELAGGSMREHDYQVLLANMKQENMNIEDMEWYLNLRKQGTIPHGGFGLGFERLISYLAGYDNVRDISAFPRAPELCNC

SEQ ID NO: 27449 - protein, 270 aa, Methanosarcina acetivorans
METIMKAACIQMNISLCSKQENLERALSLAEEAVSREAELLVFPEVFSTGFCYDRIGDVAETTSGPTLETLRAFSREHGCILAGSMIEIREGDAPGSEKKVPSQYNLGFCIESGKLAGIRRKVQLYGPEKEYFASGDSISPIKLQKYGLSIGLIVCNELRYPEVARKLVLEGADLLVSAADIPDFYIYPWRIMSFSRAIENQLPHIACNRVGKDRYSIYPGGSFIVDGWGRVLAEAGTEECVLLGEIDLVKAKELRQTGSILEDRRPDLY

SEQ ID NO: 27450 - protein, 318 aa, Candida albicans
MHTHHSHSGDYVSHAVDTLNDMVELYYKKGFQIICLTEHMPRLDNKYLYPEEIDKSYTIDNLNGDFTRYLNHARDLQLKYATKDKSSSGNMKIIIGFEVEGINIDHINYSQELLNKVQMSVGSVHFVNEIPIDFNKELWLKARESTKSKTTRELYNDYFELQYKVITQLKPTVVGHFDLIRLLQPEDDIDPTTGKLTKDVNLEIDWPDIWQLVIRNIKFVKSYGGLFELNSSALRKGWDTPYPKRDIANAIIEYGDSRFCLSDDAHSLSQVGIFYSKAWEYVESLGMENIYHLDLDDNGEVVISSKKIQELNNSLFWK

SEQ ID NO: 27451 - protein, 432 aa, Juglans nigra
MAHILTPTTRWQMRITKNSANASPMTAKMWGSLLLKQNKKGSSKSSAKFRVFATKSENSTVNRIEKLLNLDLTPYTDKIIAEYIWIGGSGIDLRSKSRTISKPVEHPSELPKWNYDGSSTGQAPGEDSEVILYPQAIFKDPFRGGNNILVICDTYTPAGEPIPTNKRHRAAEIFTNKKVADEVPWYGIEQEYTLLQQNVKWPLGWPVGGYPGPQGPYYCGAGADKSFGRDISDAHYKACLYAGINISGTNGEVMPGQWEYQVGPSVGIEAGDHIWCSRYILERITEQAGVVLSLDPKPIEGDRNGAGCHTNYSTKSMREDGGFEVIKKAILNLSLRHKDHISAYGEGNERRLTGKHETASINTFSWGVANRGCSIRVGRETEKQGKGYLEDRRPASNMDPYIVTSLLAETTILWEPTLEAEALAAQKLALNV

SEQ ID NO: 27452 - protein, 560 aa, Herminiimonas arsenicoxydans
MFEDFVFAPEKENGHDSSEPGWKILIADDEEEVHQVTAVAMIDVQFKGRKLEFLHAYSAGEARAMLAADRDIAIILLDVVMEEDDAGLKLVRHIREQMNNRRVRIVLRTGQPGQAPERDVVVDYDINDYKSKTELTRQKLLTCIISALRSYDDIVALENLSRDLERQVLERTHDLSLAKNEAEAANRAKSEFLAVMSHEIRTPMNGMLGMMQLALAQASDVEQREYLETAQYSAEALLTILNDILDFSKLESGHLEFEAVTFDLPKAVDSVIELMSARMQGAALSLNAECDADLPRLLTGDVGRLRQVLLNLIGNALKFTEQGSVTLKIERLPASGTQIPLRFTVIDSGIGITAEEQTRLFQSFSQADHSISRRFGGTGLGLSICKKIVEMQRGCIGVESTPGEGSRFWFELTFVPAPEPGEKSDIIVAPALPASRTLHILLAEDNEINQKVVVALLKKSGHTVQIAQNGREAVLAVQQGVFDVILMDMHMPEMDGLAATRAIRGMPAPACSLPIVALTAAVTLSDIQTCMDAGMNYFLAKPFRIERLNGILQELFSVKA

SEQ ID NO: 27453 - protein, 873 aa, Ashbya gossypii
MRTPRLPMKGNIAEVVLYRCSKTIKVNNYSNPRPVALDGRMMETTNTQKPLQWQTTPGEGSLEVHSPEQDRQRSISLSKFIPRSLKRNNSMNGSVESHVDAGDAEVDQEGQRASNGRQLGPGGEKRPEAGQLRGTGALPVILKENNKFASRLRSMFKASRELSQQEPNDVQQVSPEGKAEGTARHTPDGGMRVRSPSTPTFTVSRDPQPPTGQAAGTHEAIDIAPGRLQSPLMPSSHSAGGGITSKARGNRSNTVRGLNPYFAYQGLPPHAEPAHDGSQRSYDNSTFLTTPNTAQTSQTTLSYTNCSSNASAASLNDIEENEEVCSFQHTKKSPDILLQAIGCPVTPLTASESREETPLKSPVLRRVASQPTSLNKQEGQTRNNQQATDAGASLMAHQTLPVPVSCRSSSSSNMCAEASATARLEGGSPEHLELPPKRSQRLRAKSFGNKFREAVVGPQSFEKIRLLGQGDVGKVYLVREKKSDRLYALKIFGKAEMIKRKKIKRILAEQEILATSNHPFIVTLYHSFQTEDYLYLCMEYCMGGEFFRALQTRKTKCISEDDARFYASEVTAALEYLHLMGFIYRDLKPENILLHQSGHVMLSDFDLSVQAKGTRNPQVKGNAQSSLVDTKVCSDGFRTNSFVGTEEYIAPEVIRGNGHTASVDWWTLGILTYEMLFGFTPFKGDNTNQTFSNILKNDVYFPNNNDISRTCKDLIKKLLVKKESKRLGSKFGASEIKKHPFFKTVQWALLRNQEPPLIPVLTEDGYDFAKLSHKKDVKKAEKFGPSGDSTHKFKVAASIDSVEEQERIMFEEKVEHDDAVSDDDPFHDFNSMSLMKQDNNSLIYGDNNSYGKITYAPNQNRSRSNSHRSFFKR

SEQ ID NO: 27454 - protein, 121 aa, Arabidopsis thaliana
  misc_feature (83)..(83): Xaa can be any naturally occurring amino acid
MASFMVFFTGGGTFPAQATMVASFTGLESFASFPGTRKGHHHLTFITSHGRRSSCVKGGPPIGKKKVETFFYLPDLNDLELAXKEVTTLFRTRGFPGVKSKWNPELGSRNPGTLPGSYNGQ

SEQ ID NO: 27455 - protein, 741 aa, Pyrus communis
MEACNCIEPQWPADELLMKYQYISDFFIALAYFSIPLELIYFVKKSAVFPYRWVLVQFGAFIVLCGATHLINLWTFSMHSRTVAIVMTMAKVLTAVVSCATALMLVHIIPDLLSVKTRELFLKNKAAELDREMGLIRTQEETGRHVRMLTHEIRSTLDRHTILKTTLVELGGTLALEECALWMPTRTGLELQLSYTLRQQNPVGYTVPIHLPVINQVFSSNRAVKISPNSPVARLRQLAGRHIPGEVVAVRVPLLHLSNFQINDWPELSTKRYALMVLMLPSDSARQWHVHELELVEVVADQVAVALSHAAILEESMRARDLLMEQNIALDLARREAETAIRARNDFLAVMNHEMRTPMHAIIALSSLLQETELTPEQRLMVETILRSSNLLATLVNDVLDLSRLEDGSLQLEIATFNLHSVFREVHNLIKPVASVKKLSVTLNIAADLPMYAIGDEKRLMQTILNVVGNAVKFSKEGSISITAFVAKSESLRDFRAPDFFPVQSDNHFYLRVQVKDSGSGINPQDIPKLFTKFAQTQTLATRNSGGSGLGLAICKRYVNLMEGHIWIESEGLGKGCTATFIVKLGFPERSNESKLPFGPKLQANHVQTNFPGLKVLVMDDNGVSRSVTKGLLAHLGCDVTAVSLIDESLHVISQEHKVVFMDVSMPGIDGYELAVRIHEKFTKRHERPALVALTGSIDKITKENCMRVGVDGVILKPVSVDKMRSVLSEILEHRVLFEAM

SEQ ID NO: 27456 - protein, 229 aa, Leifsonia xyli
MFYWLLKYVIAGPLLRGVFRPWVVGLENVPKDGAVILASNHLSFIDSVFLPIVVDRHVSFLAKSDYFTRRGLKGWATKAFMTATGQLPIDRSGGKASEASLNTGLAVLARGEILGIYPEGTRSPDGKLYRGRTGAARMILEAGVPVVPVAMVDTAEIMPIGKRLPKFGRIGIVIGEPLDFSRFDGMEGDRFILRSVTDEIMYVLQGLGDQEYADVYASTVKEKRAAPSA

SEQ ID NO: 27457 - protein, 306 aa, Lactococcus lactis
MVKIVENITELVGNSPIIKLKNGPENGAEIYLKLEYFNPGGSVKDRIALQMIRQAEADGRLKKGGTIVEPTSGNTGIGLAMAGAALGYNVVIIMPDSYSKERRQIIQAYGAELILTPAADGIKAAIDLGQKLVEENGWFMPMQFENPANLKAHELTTGPEIIEAFGENGLDAFVACAGTGGTISGVSHYLKSQNSKIKTFVVEPAESPILTGGESGPHRIQGIGIPFMSPNLDTKAYDGVIDVTSDEALETARKIGKSEGFLVGISSGAAIWAAYELAKKLGKGQKVLALCADNGERYLSTELYDY

SEQ ID NO: 27458 - protein, 547 aa, Lactococcus lactis
MTEKILIVGGVAGGMSAATRLRRLNENAEIIVFEKGPYVSFANCGLPYYVGGEIAEREKLIVQSAKALKNRFNLEVRENSEVIAIDSEGKKVTVVSNGESYVESYDKLILSPGAKPLIPQIKGLNQATNVFSLRNIPDVDKIMTYLKAKAPKSATIIGAGFIGLEMAENLAKRGLSVTIVEKAPHVLPTIDREMAAFVNEELIKNNLSVMTNRGAVEFKNDEILLDNGESLQSDLTILSVGIQPETSLAKSAGIKLGLRNAILVDEHYETSVKDIYAVGDAIVVKNQLGQDALISLASPANRQGRQVADIISGLPIKNRGSLGTAIVRVFDLQVASTGLSEFQLRGLKINHKIVHVTANNHAGYYPDVTSIVLKLIFEPESGQIFGAQAIGKEGVDKRIDILSTAIKAKLTVFDLPELELTYAPPFDSAKDPVNMAGYAAINLLLGQSENIQWHELAAELAKGKVLLDVRNPNELAKGKFKNSQNIPLDDLRERLNELDKKNEYIVSCQSGLRSYNAERILKQEGYKVKNLDGAFGLYSKVTKELLD

SEQ ID NO: 27459 - protein, 384 aa, Unknown
  Mycobacterium sp. MCS
MARDYYGLLGVSKGASDQEIKRAYRKLARELHPDVNPDEEAQARFKEISAAYEVLSDPEKRRIVDLGGDPLESAGASGGNGFGAGFGGLGDVFEAFFGGGGGSRGPIGRVRPGSDSLLRMRLDLAECATGVTKQVTVDTAVLCDLCHGKGTHGTSTPATCDTCGGRGEIQTVQRSLLGQVMTTRPCPVCGGVGEVIPDPCHRCGGDGRVRARREISVKIPAGVGDGMRVRLAAQGEVGPGGGPAGDLYVEVHEKPHDVYVRDGDDLHCTVSVPMVDAALGTTVSVDDILGGPLELTIAAGTQPGAVSTLRGHGMPHLRSGVRGDLHAHIDVVVPAKLDHTDIELLRQLKEHRSRDVAEVRTSSSPAASNAGGLFSRLRETFTGR

SEQ ID NO: 27460 - protein, 197 aa, Brassica napus
MAASIAKPISATSLRFYSDRKNNISFSDCISISSGFRHSPPSSLDLVAKPPPTKARVSHLVRAQSSYDYIPDSKFYKVEAIVRPWRIQHVSSALLKIGIRGVTVSDVRGFGAQGGSKERHGGSEFSEDKFVAKVKMEIVVKKEQVESVINTIIDGARTGEIGDGKIFVLPVSDVIRVRTGERGEQAEKMTGDMLSSS

SEQ ID NO: 27461 - protein, 337 aa, Solanum tuberosum
AFLSSLVASLLLVGLLIQITGAQPIGVCYGKIANNLPSDQDAIKLYNANNIKKMRIYYPHTNVFNALKGSNIEIILDVPNQDLESLANPSNANGWVQDNIRNHFPDVKFKYIAVGNEVDPGRESGKYARFVGPAMENIYNALSSVGLQNQIKVSTSTYSGLLTNTYPPRDSIFREEYKTFINPIIGFLARHNLPLLANIYPYFAHIDNTNAVPLSYALFNQQGRNDAGYQYLFDALVDSMYFATEKLGGQNIEIIVSESGWPSEGHPAATLKNARTYYTNLINHVKRGAGTPKKPGRTIETYLFAMFDENEKKGEASEKHFGLFNPDQRPKYQLNFN

SEQ ID NO: 27462 - protein, 458 aa, Triticum sp.
MSGGGRPPAAQKILQSLRPPPVFSTPSRPPFASPDDYHRFHAPTTPSATGSGGIGSGGVGGDIDEGLVIRTQLKRKATREENNAAESSDCMIVTTGVTGNPLLTPVSGKAVKNSKSKTKNNKAGPQTPTPNVGSPLNPSTPAGTCRYDSSLGLLTKKFINLLKQAEDGILDLNNAAETLEVQKRRIYDITNVLEGIGLIEKTLKNRIRWKGLDDSGVELDNGLSGLQTEVENLNLQEQALDERISDMREKLRGLTEDENSQRWLYVTEDDIKGLPCFQNETLIAIKAPHGTTLEVPDPDEAGDYLQRRYRIVLRSTLGPIDVYLVSQFDDGFENLGGAATPPRHTNVPKPGPCEDLHATNATQSSKSINVEYNIQHRQNTPQDPSSSNDYGGMTRIIPSDVNTDADYWLLTEGDVSITDMWETAPEVQWDTAVFLPEDVSIPHAHHSPRMQVPSMDQP

SEQ ID NO: 27463 - protein, 458 aa, Nocardia farcinica
MEAGRKIARMAVLDEKLHEVYEEILRRNPGEIEFHQAAFEVLESLGPVVAKHPEYTDGAVLRRLCEPERQIIFRVPWVDDQGRVQINRGFRVEFNSALGPYKGGLRFHPSVYLGIVKFLGFEQIFKNSLTGMPIGGGKGGSDFDPKGRSDGEVMRFCQSFMTELYRHIGEYTDVPAGDIGVGGREIGYLFGQYKRITNRYESGVLTGKGLTWGGSQVRPEATGYGTVFFVDEILRSRGDSFEGKKVVVSGSGNVAVFAIEKVEQLGGTVVACSDSGGYVVDDKGIDLDLLKDLKQVRRGRMCDYVEERGGTARYVENQSVWDVPCDIALPCATQNELDGEAAATLIRNGVRIVAEGANMPCTPEAARAFTEAGVTFAPGKAVNAGGVATSALEMQQNASRDSWSFEHTEERLAEIMRGIHDRCLETADEYGSPGSYTAGANIAGFTRVADAMLALGII

SEQ ID NO: 27464 - protein, 192 aa, Triticum aestivum
MANPSMAAGGGVPWAEGARAVGAQIRNRLRVAPVDRRWLWRRPEGRAASEAVRQWSDRLRAILHRDKQGPDQQQQQQGPASPDASAAAAAKPSSSAFKFYRKKVGKEVNGVEDSVIFRSLQALAVPLIGNACHVFMHGLNSVQIYGAEKLQQALQERPKDKPLLTVSNHVAAMDDPFVIASLLPPSVMLEAQ

SEQ ID NO: 27465 - protein, 363 aa, Unknown
  Shewanella sp. MR-4
MNPVFTPNVAQKILFIDRDGTLIEEPITDKQVDSLAKLVFEPQVIPALLRLQKAGFRLVMVSNQDGLGTPSFPQEDFDAPHNMMMQILSSQGVKFEDVLICPHFNDENCSCRKPKLGLVKDFLTQGTIDFTQSAVIGDRHTDVELGNAMGIKSFQYQRGSLGWDAIADALLNKGRTATVVRTTKETDIRVTVDLDNASKGTINTGIGFFDHMLDQIATHGNFKMEVNVDGDLEIDDHHSVEDTALAIGDALRQALGDKRGIARFGFSLPMDEAKGECLLDLSGRPFIKFAAQFEREKVGEMATEMVPHFFRSFADGLRCTLHVAAEGDNDHHKVEALFKVLGRALRHAIKVEGDVLPSSKGVL

SEQ ID NO: 27466 - protein, 561 aa, Bacillus anthracis
MIHLKTQYTVSTYLLDRLSELGIEHIFGIPGDYNLAFLDYVLAHKNLEWIGNCNELNAAYAADGYARIKGIAALITTFGVGELSAINGIAGSYAENVPVIKITGTPPTTVMENGELVHHTLGDGKFNHFSKMYREITIAQTNLTPEHAVEEIDRVLRACWNEKRPVHINLPIDVYNKPINRPAEPILHKPILSNKETLDKMLLHAISKINSAKKPIILADFEVDRFHAKEYLYQFVEKTGFPIATLSMGKGIFPEKHPQFIGVYVGDVSPPYLRKRIDESDCIISIGVKLTDTITGGFTQGFTKEQVIEIHPYTVKITDKKYGPVVMKDVLQQLSDVIEHRNEETLDIKPFISESLSMTEEFNPKAHMVTQKRFWQQIYHFLQENDVLLAEQGIPFFGSAAIPLPNNTTYVAQPLWGSIGYTLPALLGTQLANLSRRNILIIGDGSFQLIVQELSTILRQNLNPIIFLINNNGYTVERAIHGQNEPYNDIQMWEYTKLAKVFGTEEKSQTFKVQNETELQEVLTKISIDKNQLTFVEIVMSQGDQPELLAKLGKRFGQQNS

SEQ ID NO: 27467 - protein, 184 aa, Arabidopsis thaliana
  misc_feature (21)..(21): Xaa can be any naturally occurring amino acid
  misc_feature (46)..(46): Xaa can be any naturally occurring amino acid
  misc_feature (88)..(88): Xaa can be any naturally occurring amino acid
  misc_feature (101)..(101): Xaa can be any naturally occurring amino acid
  misc_feature (130)..(130): Xaa can be any naturally occurring amino acid
  misc_feature (145)..(146): Xaa can be any naturally occurring amino acid
MAISMLSSATMDASPDRVTMXAPFKVIHSSAAFPATRRAKKDITSXITINGRRVNCMPGCSPMGRKKFETLSYLPDHTESKLDIVDDXLMLMKGMPCGEFXLEQGFGYREDVISPRYYDCDGHCTMWKLXMIGCTDSAQVSNELXXCYKEYPNVLLYGFVGFEHTRQALCINCIGYHSEASQKS

SEQ ID NO: 27468 - protein, 225 aa, Brassica napus
  misc_feature (201)..(201): Xaa can be any naturally occurring amino acid
MDQQEHGQSRAMNYSTNPYQTGSVGPTAPSGQMAFHQHHQQQQLTQQLQVFWENQFKEIEKTTDFKNQSLPLARIKKIMKADEDVRMISAEAPVVFARACEMFILELTLRSWNHTEENKRRTLQKNDIAAAVTRTDIFDFLVDIVPREDLRDEVLGSIPRGTVPEASATGYPYGYLPSGTAPVGNAGMVMGNPDSAYPPNXPYMGQPMWQHQETGNLNSKTSLEF

SEQ ID NO: 27469 - protein, 509 aa, Exiguobacterium sibiricum
MALAADIKAQLAQYLDLLEGDLVLAVSAGTDSVSLEMSELVEEIASMSTRISIEQAALPRTPSFSVNRVGEESGITFAGIPLGHEFTSLVLALLQVSGRAPKIDAALIEQIKGIKETYHFESYISLSCHNCPDVVQALNVMSVLNPNISHTMIDGGAFKQEVEAKEIMAVPTVFVNGEAFGNGRMSLEEILAKLGTGVDASDFADKDPYDVLVVGGGPAGASAAIYAARKGIRTGIVAERFGGQVMDTMSIENFISMKYTEGPKLVASLEEHVKEYGIDVMNLQRATRLEKKDLVELELENGAVLKTKSLILSTGARWRNIGVPGELEFKNKGVAYCPHCDGPLFEGKRVAVIGGGNSGVEAAIDLAGLVKHVTVLEFAPELKADAVLQDRLASLPNVTVVANAQTKEITGTDKVNGITYVERETGAEHHVELEGVFVQIGLVPNTDWLGETIERNKFGEILVDRHGATNIPGVFAAGDCTDSAYKQIIISMGSGATAALGAFDYMIRN

SEQ ID NO: 27470 - protein, 551 aa, Medicago truncatula
MSDEVPKAEFSDSVLIKSIIRREDGGSGLAGKKARIGGWVKTGRKADKDAFAFLELNDGSCAGNLQVIIDASLADLGQLVQTGTCVVVEGHLKLPPSGAKQKIELRAEEVLHVGPVDPAKYPLPKTRLTLESLRDFVHLRSRTNTISAVARIRNALAYATHTFFNKHGFLYVHTPIVTTSDCEGAGEMFQVTTLFSEAERLEKELIQNPPPTEADVEAAKLVVQEKGEVVSQLKSAKADKKEISAAVAELKKAKENVSKLEERSKLQPGIPRKDGKVDYTKDFFARQAFLTVSGQLQVESYACALSRVYTFGPTFRAENSHTSRHLAEFWMVEPEIAFADLEDDMKCAEAYVKFLCRWLLDNCLEDMEFMADKFDKGCIDRLKMVASTPFIRLTYTEAVEILEESVQNGKKFEKEVEWGIDLASEHERYLTEVKYQKPVIVYNYPKDIKAFYMRLNDDLETVAAMDVLVPKVGELIGGSQREERYDVIQQRLEEMDLPVEPYEWYIDLRRYGTVKHAGFGLGFERMILFATGLENIRDVIPFPRYPGRADL

SEQ ID NO: 27471 - protein, 466 aa, Exiguobacterium sibiricum
MLHSIGVIGLGVMGRNIALNMASRQEDVAVYNYTRDLTDDLMAHNEGLPVHPYYEVADFVQSLARPRKIFVMVTAGSAIDSVIESLIPHLETGDIIMDGGNSHFHDTERRFDQLQQHGIEYIGVGVSGGEVGARTGPAIMPGGTKEAYEQVAPILTKIAAQVNGDPCCVYIGPKGAGHFVKMVHNGIEYADMQLIAEAYSFLRVRLGLDVEEIADVFASWNEGELKSYLIEITADILRKKDDETGLPLIDVILDQAGQKGTGKWTSMQSIDNGIASSIITEALFARYLSAVKEERVAAATVLGGPEARETLDKDVWIERIRQALYMGKIAAYAQGFTQYRTSSELYDWNLRLEEIALIFRGGCIIRADFLNVISEAFAKDESLANLMLAPYFADKVQDYQTALRQVVAESSLSGLAAPCLSTSLTYYDSYRTANSNANILQAQRDYFGAHTYARTDREGTFHTEWQ

SEQ ID NO: 27472 - protein, 137 aa, Salmonella enterica
MSEALKILNNIRTLRAQARECTLETLEEMLEKLEVVVNERREEESAAAAEVEERTRKLQQYREMLIADGIDPNELLNSMAAAKSGTKAKRAARPAKYSYVDENGETKTWTGQGRTPAVIKKAMEEQDKQLEDFLIKE

SEQ ID NO: 27473 - protein, 327 aa, Zea mays
MPINFESDHQLKPPVISYCLCHTAAAATLPRLRVTPSWEGRARVAHSLARMQLSHTAPRMQEPGRRPVPPFAGVDLRRPRGYPAPAAKEAEEEPAPAPAPGGDPCPRCGSRDTKFCYYNNYNTSQPRHFCKSCRRYWTKGGSLRNVPVGGGTRKSGSSSSASATATPTSTGAAPKSPRSSKNSKRRRVGPAPAPAPAPDPAPATATATADVANTAPSTEASAATRAASEKPAATEPAAATGAASEKPAATELAAAVVSTEKPPAAVGGFTDTSTAPETGLADVCSGGVKELVPDPGHFEWPSGCDLGSYWGTSVFADTDPALFLNLP

SEQ ID NO: 27474 - protein, 162 aa, Corynebacterium efficiens
MEAMTSIHDIPVTLTDGTETTMADWAGHLVMVVNVASRCGLTPQYEGLQRLFEDYQDRGFFVIGVPCNQFMGQEPGTDAEICTFAQEKYDVTFPLLAKTDVNGENEHPLYTELKRFGEGGDIEWNFEKFLINADGETIARFGPRMDPEDDEVTSVIEDNLPV

SEQ ID NO: 27475 - protein, 586 aa, Oryza sativa
MEETPLPSGKNFRSQLAAAARSINWTYAIFWSISTSRPGVLTWKDGFYNGEIKTRKITNSMNLTADELVLQRSEQLRELYDSLLSGECGHRARRPVAALLPEDLGDTEWYYVVCMTYAFGPGQGLPGKSFASNEFVWLTNAQSADRKLFHRALIAKSASIKTIVCVPFIMHGVLELGTTDPISEDPALVDRIAASFWDTPPRAAFSSEAGDADIVVFEDLDHGNAAVEATTTTVPGEPHAVAGGEVAECEPNADNDLEQITMDDIGELYSLCEELDVVRPLDDDSSSWAVADPWSSFQLVLTSSPAPDQAPAAEATDVDDVVVAALDGSSIDGSCRPSPSSFVAWKRTADSDEVQAVPLISGEPPQKLLKKAVAGAGAWMNNGDSSAAAMTTQESSIKNHVMSERRRREKLNEMFLILKSVVPSIHKVDKASILAETIAYLKELEKRVEELESSSQPSPCPLETRSRRKCREITGKKVSAGAKRKAPAPEVASDDDTDGERRHCVSNVNVTIMDNKEVLLELQCQWKELLMTRVFDAIKGVSLDVLSVQASTSDGLLGLKIQAKFASSAAVEPGMITEALRKAIAS

SEQ ID NO: 27476 - protein, 331 aa, Vibrio cholerae
MIFDSQSSRVSMIKKIGVLTSGGDAPGMNAAIRGVVRTALGAGLEVFGIYDGYQGLYEDRIKQLDRSSVSDVINRGGTFLGSARFPQFREVEVREKAIENLKKHGIEALVVIGGDGSYMGAKKLTEMGFPCIGLPGTIDNDIAGTDYTIGYLTALNTVIEAIDRLRDTSSSHQRISIVEIMGRHCGDLTLTSAIAGGCEYIITPETGLNMEQLISNIKDGIAKGKKHAIIALTELMMDANKLAKEIESATGRETRATVLGHIQRGGKPTAFDRVLASRMGNYAVHLLMEGHGGRCVGIQKEQLVHHDIIDAIENMKRPVRTDLYKVAEELF

SEQ ID NO: 27477 - protein, 116 aa, Sesbania rostrata
LVNVYPYFSYSGNPRDISLPYALFTSPNVVVWDGQYGYQNLFDAMLDAVHAAIDNTKIGFVPVVVSESGWPSDGGFAATYDNARIYLDNLIRHVGKGTPRRPWPTETYIFAMFDEN

SEQ ID NO: 27478 - protein, 552 aa, Candida albicans
MSQSIYVNEKSGVDTTEAKGTQEKPYATPAFALYTHPDAKVFVYKQSEEDAEKFEYVEISASALKKAKKGVEGLKKKAEKQAKLEEQKKQQQATAKLAELDLSSIEEDKSLPSAQKIKIRQLKDHLDTRVLVQGWVHRLRVQKGLAFITLRDGTGYLQCVLTGDLAKAKQTQELTIESTVAIKGVISKLPEGKTAPGGVELKADHYQIIALAPGGDESFTNKVQENADPNLLLDQRHLALRGESLSAVMKVRAAYSAAIRRFFTEEGLTEVTPPCMVQNQVEGGSTLFKLDYYGEEAYLTQSSQLYLETCLASLGDVYCIQESFRAEKSHTRRHLSEYTHIEAELVFITFEDLLTHLEKLLSKTIQYVLEDPVAGPIVKQLNPDFKAPKAPFKRMEYIEALDWLNEHGIPNEDGEKFKFGDDIAEAAERKMTDTINEPILLTRFPAEIKSFYMQRCKDDPRVTESVDVLMPNVGEITGGSMRIDNYDELMAALKRENLNLDSYYWFTDVRKYGSAPHGGYGIGLERQLAYMLNRYTVRDCSLYPRFTGRCKP

SEQ ID NO: 27479 - protein, 108 aa, Legionella pneumophila
MSDHIKTVTDASFEQDVINSSKPVLVDFWAEWCGPCRALTPILEEVAATHSKDMTFAKINIDENPQAPAKFGVMSIPTLILFKNGQVEAVKMGLLSKSQLSAFVESNL

SEQ ID NO: 27480 - protein, 297 aa, Unknown
  Oceanobacter sp. RED65
MDYPTIADFVGNTPLVKLQRLGRQSSNTILLKLEGNNPAGSVKDRPALSMITEAEARGDIQPGDNLIESTSGNTGIALAMAAAMKGYNMTLIMPDNLSMERRWAMEAYGAELILVTKDEGMEGARDLALKMQEEGKGKVLDQFGNQDNPLAHYKGTGPEIWRDTKGTITHFVSSMGTTGTIMGTSRYLKEQNPNIQIVGLQPKEGAAIPGIRRWPEAYLPKIFDATRVDQVLDIGQEEAEVTMRELAMKEGIFCGVSSGGSVAAALKLDEELENAVIVCIICDRGDRYLSTGVFSTE

SEQ ID NO: 27481 - protein, 144 aa, Brassica napus
  misc_feature (2)..(2): Xaa can be any naturally occurring amino acid
  misc_feature (11)..(12): Xaa can be any naturally occurring amino acid
  misc_feature (17)..(18): Xaa can be any naturally occurring amino acid
  misc_feature (21)..(22): Xaa can be any naturally occurring amino acid
  misc_feature (26)..(26): Xaa can be any naturally occurring amino acid
  misc_feature (29)..(29): Xaa can be any naturally occurring amino acid
  misc_feature (43)..(43): Xaa can be any naturally occurring amino acid
  misc_feature (49)..(50): Xaa can be any naturally occurring amino acid
  misc_feature (59)..(59): Xaa can be any naturally occurring amino acid
  misc_feature (62)..(62): Xaa can be any naturally occurring amino acid
  misc_feature (65)..(65): Xaa can be any naturally occurring amino acid
  misc_feature (67)..(67): Xaa can be any naturally occurring amino acid
  misc_feature (95)..(95): Xaa can be any naturally occurring amino acid
  misc_feature (98)..(98): Xaa can be any naturally occurring amino acid
  misc_feature (107)..(107): Xaa can be any naturally occurring amino acid
  misc_feature (109)..(109): Xaa can be any naturally occurring amino acid
  misc_feature (122)..(122): Xaa can be any naturally occurring amino acid
  misc_feature (126)..(126): Xaa can be any naturally occurring amino acid
  misc_feature (141)..(142): Xaa can be any naturally occurring amino acid
MXSSMLSSAAXXTSPAXXTMXXPFTXLKXSAAFPVTRKANNDXTSIASXXGRVSCMKVXPPXGKXKXETLSYLPELTEVEWDKEVDYLLRNKWIXLCXEFELEHGFXVXREHGSTPGILTMXRYWXQWWKASPWVGCTDSXXRG

SEQ ID NO: 27482 - protein, 609 aa, Oryza sativa
MSALTTSQLATSATGFGIADRSAPSSLLRHGFQGLKPRSPAGGDATSLSVTTSARATPKQQRSVQRGSRRFPSVVVYATGAGMNVVFVGAEMAPWSKTGGLGDVLGGLPPAMAANGHRVMVISPRYDQYKDAWDTSVVAEVKVADRYERVRFFHCYKRGVDRVFIDHPSFLEKVWGKTGEKIYGPDTGVDYKDNQMRFSLLCQAALEAPRILNLNNNPYFKGTYGEDVVFVCNDWHTGPLASYLKNNYQPNGIYRNAKVAFCIHNISYQGRFAFEDYPELNLSERFRSSFDFIDGYDTPVEGRKINWMKAGILEADRVLTVSPYYAEELISGIARGCELDNIMRLTGITGIVNGMDVSEWDPSKDKYITAKYDATTAIEAKALNKEALQAEAGLPVDRKIPLIAFIGRLEEQKGPDVMAAAIPELMQEDVQIVLLGTGKKKFEKLLKSMEEKYPGKVRAVVKFNAPLAHLIMAGADVLAVPSRFEPCGLIQLQGMRYGTACACASTGGLVDTVIEGKTGFHMGRLSVDGKVVEPSDVKKVAATLKRAIKVVGTPAYEEMVRNCMNQDLSWKGPAKNWENVLLGLGVAGSAPGIEGDEIAPLAKENVAAP

SEQ ID NO: 27483 - protein, 540 aa, Debaryomyces hansenii
MIHTIVTPAFSSTLSGVGATGLLKEHLLHPVVEEMASIDSDTGDLSTSPSSVSSDLPVTSKTMLQKAVEGLTQNVDPCSLKHHSDCLLDDFNESLSENSKLTMLPNYNISPTGNEEGNYLIIDVGGSTLRVAVIRIDPFVNESEDRSERVHIIIEKKWHISDSSKTIDSEFFRWVSSKVYETLEEQDLIRAEDLVINTGISWSFPLEQVSHNSGKIVYVGKGYTIASDIYNQDLKFILEKSLSDNYNITIDIKTIINDSLAVYSAGSFMDKHMKLALVLGTGFNMCCSLRTGNLHEQKKLNQDAILLNTELSLFGHTLISDLANKYDSKIDKRFDFKGGDLNFKPHMTVDPLTNDIFQPCELMTSGRYLSELTRLILIDLIEAKEIFAELDDNDLCPIFKNYEGITGQLMCYISEVEDEVLITEKVCEEFGWNKSLITLSDISKLKVVVNSVIQRAAFIVAITMVSFIKLLDHHNGCYGQDLLTIGYVGSVLLHFKNYRKLILKYVNDNEDIKRLNIKIDFKSIDNSSIVGAAIGAAYYK

SEQ ID NO: 27484 - protein, 292 aa, Kineococcus radiotolerans
MPTPPTGPVVVLTGATSGLGCLAALDLAARGAHLILPARDPDRAQATVDAVRARNPSARTEVVEVDLTRLHQVRAAGRRIAQQHEHVDVLVNNAGVHAFTPRTTVDGLPQMVAVNYLAPWVLTQALLPALRRSAAARVVTVASEASRRHGTLSLPDDLTDLSPFTARGSSPRYGKTKLLDIMFTLELAERLRGTSVVANCLDPGFNVTGLGRDLRLARPLELLLTRLRIGDPRRGAGLIVHLATHPSYGNVSGRYVTVRGPREITPAAPADDPAARRRLWNVTEELLHERVP

SEQ ID NO: 27485 - protein, 1455 aa, Clostridium perfringens
MFSKKTIANILSIALFSNIVINNFSINEVLANVKKVKIEDGVFWANNPEKFEDNREKAHATLMPFNSIEEALNNPNYSDYSNSENYMSLNGEWKFNLVETYDKDIKDFYKTDFDSSSWNTIPVPSSWQLHGYDQPRYNDTAYPWEYQDNIPEPPDVPTDYNPIGYYKKTFTIPEGWDNKEVFVSFQGVESAYYLYINGEYVGYSEDSFTGHDFNIGKFLKEGENEISVKVHRWSDGSWLESQDMIKLSGIFRDVFLYSTPKAHIRDYTLVTDLDDKYRDSNLNVEIDISNYGIKAGKYKIKGILYDENKKIVNEDISEFELNDEENVLVSINTRVENPKKWTAETPNLYTYVIALENENGEVVETISNKFGFRKIEIKNNQVCINGQPISFKGVNRHEFLPDTGRTLTEESMIEDIKLMKKNNINAVRSSHYPNDPRWYDLCNEYGLYVMDEANLETHGRLDDIPQSRPEWTEAVIDRQRSMLERSKNETSIIMWSLGNESSGGENFEIAAKWIKENDPTRLVHYEAERTVGDVYSRMYRTIEEMEAYANDPDNKKPYIQCEYAHGMGNSIGNLQKYWDVFDKYDIMQGGFIWDWADQAIRMKDKNTGEEFLSYGGDWGDSEFTDGNFCANGLVSADRTVQPELQEVKKVYQEIEIEDIDILNGKVKIVNEHLFTNLNKYKGKWELRADDNILQNGELDISVDPLSSKEFTIPFKKPELSPGVEYWLNISFELKDDEPWAEKGYVISKEQFKLPFDNEMEKGIDLNSMNSIELKNDENNVQIIGDGFKVSFDKKLGALESYKIDKEGNEIELIEEPIRPNYWRAPNDNDKGFGAEERFDTWRYAGANAKVENLEVIEVGDKAVKVNVDFILPTNIESKLNVEYIVYGNGEVSVNNTLNASKGLSEIPEIGMMLKLPKEFDSITWYGRGPEENYIDRNTGYDIGVYNKNVKDFFFPYLEPSETGNRTDTRWVTLTNNNGVGLMASGIPSIEFNALQYTPEELSSGKRHPHELAKEDSIVLRINHRQMGVGGDNSWGATPHREFMNESGKIYNYSFKIKGIDKSSSPMEISKKNLKEDLIKDIKIDGVSLRGFNENITEYNIDYLEKTLEKPPVIEVVKANDNIDVEVENVYTIPGKATIKVNHKDELLNKIYTKEYVINFGTHNVEYLSDISWKSATSGMYEPVKDRSVVNNPLVLKIDGEIKTFDKGVGVNSNSEIVVDLKGKGYEKFEAYVGMDRGVSGYGSSIVARVEVDGKEVFNSEKIYSTSNCHKVEVDLKGAEKLALYIDDYDNNIKYDHGNWADAKFIKAEANKDTSLKALKVNGENLKGFNTNTFEYDVNLSKDSHIPKIEAIAMNENSKVFIEDALSIPGTSYIKVISEASTMKTYKINFELNGNSTEDDEKPGDVEKPNDNDLDENNKPEDSEGLPNTGQSVINFAIIGIISSLAGVKLLRRKNK

SEQ ID NO: 27486 - protein, 741 aa, Pyrus communis
MEACNCIEPQWPADELLMKYQYISDFFIALAYFSIPLELIYFVKKSAVFPYRWVLVQFGAFIVLCGATHLINLWTFNMHSRTVAIVMTTAKVLTAVVSCATALMLVHIIPDLLSVKTRELFLKNKAAELDREMGLIRTQEETGRHVRMLTHEIRSTLDRHTILKTTLVELGRTLALEECALWMPTRTGLELQLSYTLHQQNPVGYTVPIHLPVVNQVFSSNCAVKISPNSPVARLRQLAGRHIPGEVVAVRVPLLHLSNFQINDWPELSTKRYALMVLMLPSDSARQWHVHELELVEVVADQVAVALSHAAILEESMRARDLLMEQNIALDLASREAETAIRARNDFLAVMNHEMRTPMHAIIALSSLLQETDLTPEQRLMVETILKSSNLLATLINDVLDLSRLEDGSLQLDIATFNLHSIFREVHNMIKPVASIKRLSVALNIAADLPVYAIGDEKRLMQIILNVVGNAVKFSKEGSISITAYVAKSESLRDFRAPDFFPVQSDNHFYLRVQVKDSGSGINPQDIPNLFTKFTQTQTLASQNSGGSGLGLAICKRFVNLMEGHIWIESEGLGKGCTATFIVKLGFPERSNESKQPFAPKLQANHVQTNFPGLKVLVMDDNGVSRSVTKGLLVHLGCDVTTVSSIDEFLHVISQEHKVVFMDVCMPGIDGYELAVRIHERFTKRHERPVLVALTGSIDKMTKENCMRVGMDGVILKPVSVDKMRSVLSELLEHRVLFEAM

SEQ ID NO: 27487 - protein, 152 aa, Arabidopsis thaliana
MAEAARRQGGGRPLPPPPRGVNQQPPRPKPEPVDREKTCPLLLRVFTKSGGHHTSEDYAVRGKEPKDEVQIYTWKDASLRELTDLVKEVSVAARRRNARLSFAFVYPNNKGGYNVREVGETMAYPNRKQPDDSKTLSELPFEIGDYLDVAIY

SEQ ID NO: 27488 - protein, 313 aa, Nicotiana tabacum
MATSHFILKLFLVISFCNVCFASRKLTALVQEPENQLLQYHKGALLFGKISVNLIWYGKFKPSQRAIVSDFITSLSSSTPSKTDPSVAKWWKTTEKYYHLANSKKSLSLYLGKQVLVENYSLGKSLTQKQIVQLASKGEQKDAINIVLTASDVAVDGFCVNRCGTHGSSKGAIIRGKTYKFAYIWVGNSETQCAGYCAWPFHQPIYGPQSPPLVAPNNDVGVDGMVINLASLLAGTATNPFGNGYYQGEADAPLEAASACPGVYAKGAYPGYAGDLLVDKTTGASYNAHGTNGRKYLLPALYDPSTSTCSTLV

SEQ ID NO: 27489 - protein, 304 aa, Kineococcus radiotolerans
MNANWTARHVPDQSGRVAVVTGANTGLGLETARTLAERGATVVLAVRDVDKGARAAAGLTGNAPGNVVVQRLDLSSLESIRAAASALRDAHPRIDLLVNNAGVMYTPRQTTRDGFERQFGTNHLGHFALTGLLLERMLPVPGSRVVTVSSTGHRIRAAIRFDDLQGERSYSRAAAYGQSKLANLMFTYELQRRLAAHGTTTVAVAAHPGVANTELVRNSPAAVRAAVDRLAPLLTQPAAMGALPTLRAATDPSVLGGQYYGPGGRGEVRGYPRLVTSSPQSYDLADQRRLWAVSQELTGVEFPL

SEQ ID NO: 27490 - protein, 588 aa, Novosphingobium aromaticivorans
MTPGVFLADGATRFSVRSPRAEALTLCLFEDEAEQRIAMTRVGDNWIVEIPRDLRGIRYGYRASGEWNPPDGLWFDPAKLLVDPYAIELDGSFVQHTSLSTYGADTSKIVPKAVVTAPPVISHLSPLFRHGGLIYEVNVRGLTMLHPDVPQPLRGTVAALAHPAIIGHLKQLHVSAVELMPIVAWIDERHLPPLGLTNAWGYNPVAPMALDPRVCPGGVRELRETVATLRAEGIGVILDIVLNHSGESDVLGPVLCLRGLDDAAYTKAPDGRLINDTGCGNTLDFGNPAVRALALDTLRHFTRHCGVDGFRFDLAPILARSPGFAADAPIFREIAADPVLADRVMIAEPWDIGPGGYQLGGFPSNWLEWNDRFRDDVRRFWKGETGVGALATRIAGSSDIFGKACRTVNFLAAHDGFTLADTLAYEQRHNWANGEENRDGHGENFSWNNGMEGETDNLDVLSRRAALVRAMLGTLFISTGTILLTAGDEFGRSQRGNNNAYAQDNEITWIDWDRRDRALEAWTFGLSAWRHLRISSFTRFPEDGTWRDLNGTELHTSAWESDLTQGFFWQNGSYGFVVDRTAPMAGPV

SEQ ID NO: 27491 - protein, 985 aa, Streptococcus thermophilus
MKLRQSLNGKWKIHYAQNTNQVLKDFYKTEFDETDLNFINVPGHLELQGFGSPQYVNTQYPWDGKEFLRPPQVPQESNAVASYVKHFTLNDALKDKKVFISFQGVATSIFVWVNGNFVGYSEDSFTPSEFEISDYLVEGDNKLAVAVYRYSTASWLEDQDFWRLYGIFRDVYLYAIPKVHVQDLFVKGDYDYQTKAGQLDIDLKTVGDYEDKKIKYVLSDYEGIVTEGDASVNGDGELSVSLENLKIKPWSAESPKLYDLILHVLDDDQVVEVVPVKVGFRRFEIKDKLMLLNGKRIVFKGVNRHEFNARTGRCITEEDMLWDIKVMKQHNINAVRTSHYPNQTRWYELCDEYGLYVIDEANLETHGTWQKLGLCEPSWNIPASEPEWLPACLDRANNMFQRDKNHASVIIWSCGNESYAGKDIADMADYFRSVDNTRPVHYEGVAWCREFDYITDIESRMYAKPADIEEYLTTGKLVDLSSVSDKHFASGNLTNKPQKPYISCEYMHTMGNSGGGLQLYTDLEKYPEYQGGFIWDFIDQAIYKTLPNGSEFLSYGGDWHDRPSDYEFCGNGIVFADRTLTPKLQTVKHLYSNIKIAVDEKSVTIKNDNLFEDLSAYTFLARVYEDGRKVSESEYHFDVKPGEEATFPVNFVVEASNSEQIYEVACVLREATEWAPKGHEIVRGQYVVEKISTETPVKAPLNVVEGDFNIGIQGQNFSILLSRAQNTLVSAKYNGVEFIEKGPKLSFTRAYTDNDRGAGYPFEMAGWKVAGNYSKVTDTQIQIEDDSVKVTYVHELPGLSDVEVKVTYQVDYKGRIFVTANYDGKAGLPNFPEFGLEFAIGSQFTNLSYYGYGAEESYRDKLPGAYLGRYETSVEKTFAPYLMPQESGNHYGTREFTVSDDNHNGLKFTALNKAFEFSALRNSTEQIENARHQYELQESDATWIKVLAAQMGVGGDDTWGAPVHDEFLLSSADSYQLSFMIEPLN

SEQ ID NO: 27492 - protein, 466 aa, Exiguobacterium sibiricum
MKEGTFRRKMESRHIVMLSLGGVIGTGLFLSTGYTLEQAGRVGTILSYLVGALAIYLVMLCLGELAVHMPETGAFHSYATKYIGSGTGYTVAWLYWLTWTVALGSEFTAAGLLMQRWFTDVPVWLFSALFVVMILGINVLTVRLFAEVEFWFSAVKVLTILVFIVLGTAAIVGFLPLADGSQAPLLAPLTEGGLFPNGAFAILMTMLAVNFAYSGTELIGIAAGEAVDPKRTVPLAIRTTVFRLVLFFVGTIIVLAILLPNDSKGVLESPFVAVFERIGLPFAADIMNFVILTAILSAANSGLYAASRMLWSLSDQRMITPYFSKLNASGVPTRAVLFSMLGGLLALFSSVYAPGSVYIALVSISGLAVVVVWMSISASQFMFRKRYLQEGHDLNDLVYRTPWYLFVPILSFLMCLASLIGIAFDPTQRVALYFGVPFIAVCYIVHHLTKTSWKRSVEDVKEQQSS

SEQ ID NO: 27493 - protein, 419 aa, Novosphingobium aromaticivorans
MRDTYSQPLARDAMAYVLAGGRGSRLKELTDNRAKPAVYFGGKSRIIDFALSNAINSGIRRIGVATQYKAHSLIRHMQRAWNFMRPERNESFDILPASQRVSEHQWYEGTADAVYQNLDIIASYAPKYMVILAGDHIYKMDYELMLRQHVESGADVTIGCLVVPRIEATGFGVMAVDTSDTITAFVEKPANPPGIPGNEDMALASMGIYVFDTKFLFDILREDAADPSSSRDFGNDIIPKIVRNGKAVAHRFTASCIRAAEEIEEYWRDVGTLDAYFEANLDLTDVVPKLNMYDRDWPIWTDQIIAAPAKFVHDEDGRRGMAISSLISQDCIVSGAIARRSLLFTGVKMGSFSSCEEAVILPYCNIGRGARLSRVILDSGVRIPEGLVVGEDPELDARRFQRTESGVCLITKRMIDQLA

SEQ ID NO: 27494 - protein, 700 aa, Oryza sativa
MSVSSSSMGGGGGGDAGGRTVVWFRRDLRVEDNPALAAAARAGGEVVPAYVWAPEEDGPYYPGRVSRWWLSQSLKHLDASLRRLGAGKLVTRRSADAVVALLQLVRDTGATRLFFNHLYDPISLVRDHRLKEMMAAEGIIVQSFNADLLYEPWEVVDDEGQSFTMFAPFWNRCLSMPYDPAAPLLPPKRINSGDLSMCPSDDLIFEDDSERGSNALLARAWSPGWQNADKALTAFLNGPLIHYSVNRKKADSASTSLLSPYLHFGELSVRKVFHLVRMKQLVWSNEGNRAAEESCTLFLRSIGLREYSRYLSFNHPCSHEKPLLAHLRFFPWVINECYFKIWRQGRTGYPLVDAGMRELWATGWLHDRIRVVVSSFFVKVLQLPWRWGMKYFWDTLLDADLESDALGWQYISGSLPDGRELDRIDNPQLEGYKFDPHGEYVRRWLPELARLPTEWIHHPWDAPASVLQAAGVELGSNYPLPIVGLDAANARLQEALSEMWQLEAASRAAMDNGMEEGLGDSSEVPPIEFPRELQMEVDREPARVTANVLTTARRREDQMVPTMTSSLNRAETEISADFMNSVDSRAEVPTRVNFEPATEREENFRTTAGNVARTNGIHEHNNFQQPQHRMRNVLAPSVSEASSGWTGREGGVVPVWSPPAASDHSETFASDEADISSRSYLDRHPQSHRLMNWSQLSQSL

SEQ ID NO: 27495 - protein, 131 aa, Glycine max
  misc_feature (59)..(59): Xaa can be any naturally occurring amino acid
  misc_feature (78)..(78): Xaa can be any naturally occurring amino acid
  misc_feature (90)..(90): Xaa can be any naturally occurring amino acid
  misc_feature (112)..(112): Xaa can be any naturally occurring amino acid
GFLAHLVRLFSVRQRGVRTWYSRASFSDALPSAAYDPIVMRDAIVLAVIERFMTDVPFXSLLCGGLYSSLAACITSRXYLSNTKAVLQWXAQSRAFLGGLVVSTICGSEELXDYLCTVRHESTLSVQDGTY

SEQ ID NO: 27496 - protein, 113 aa, Arabidopsis lyrata
STGKRSEREEDTDPQGSRGISDDEDGDNSRKKLRLSKDQSVILEETFKDHSTLNPKQKQALAKQLGLRARQVEVWFQNRRARTKLKQTEVDCEFLRRCCENLTEENRRLQKEV

SEQ ID NO: 27497 - protein, 525 aa, Glycine max
MDSSSSSPNNNNHHKLGFQPARSRSRLAMASPANTSEPKIVTGTAGYILEDVPHFTDYIPNLPTYPNPLQDNPAYSVVKQYFVHVDDSVPQKVVVHKDGARGVHFRRAGPRQKVYFEADEVQAAIVTCGGLCPGLNTVIRELVCGLHHMYGVKKVLGINGGYRGFYARNTITLTPKSVNDIHKRGGTVLGTSRGGHDTKKIVDSIQDRGINQVYIIGGDGTQKGASAIFEEVRKRGLKVSVVGIPKTIDNDIPVIDKSFGFDTAVEEAQRAINAAHVEAESVENGIGVVKLMGRNSGFIAMYATLASRDVDCCLIPESPFYLEGPGGLYEYIEKRLKENGHMVIVIAEGAGQELVSESVQSMSKQDASGNKLFQDVGLWISQKIRDHFAAQKTLPITLKYIDPTYMIRAIPSNASDNVYCTLLAQSAVHGAMAGYTGYTSGLVNGRQTYIPFYRITERQNHVVITDRMWARLLSSTNQPSFLDAKGDNEEKEEEEALNQLPDGHCAKDTSLASKEINSSIYPTAC

SEQ ID NO: 27498 - protein, 908 aa, Pseudomonas aeruginosa
MSTDSPLRTTASTCCYCGVGCGVLIEHDGERILGVQGDPRHPANFGRLCSKGASLHLTGDLQARALYPQLRLGKQLARARSDWESALEHAAGRFAETIREHGPDSVAFYISGQLLTEDYYAFNKLARALVGTNNIDSNSRLCMSSAVVGYKRSLGADAPPCSYEDLDCADCVLIAGSNMAFAHPVLFRRLEAAKAARPEMRIVVIDPRRTDTCELADLHLALLPGTDVALFHGILHILLWEDWIDRSFIAEHTEGFADLKELVRDYTPAAVADICGIDRADLQRCAEWIGRSPRFLSLWCMGLNQSSAGSAKNSALINLHLATGKIGRAGCGPFSLTGQPNAMGGRETGSLATLLPGHREAADPGHRAEVAHYWGVEQLPTSPGLSAIELFDAVHDGRIKALWIACTNPAQSLPDQRKIHEALARCPFVVVQEAFAGTETCQYADLLLPAASWGEKEGSVTNSERRVSHVRRAVPPPGEARQDWNIVCDFARRLEGHLRPAKPGLFAFADSRSLFDEYKLLTAGRDLDLSGLSYALLDRLGPQQWPFPSGAEHGTARLYADGRFPTASGRAQLVAEPYRAAQEKRDARYPLTLNTGRLRDQWHGMSRTGTCARLFGHEEEALVHLHPEELRRRQLRDGQLVRLKSRRGALILPVSADDSVRPGQAFLPMHWGDRFLKGLGCNVLTLPAFDPLSKQPELKHAGVQVESVELPWRLFALVETDIQARFEALRALCEVFDHASFSLAGRERPALLVSAAHHEAPGADLLERIDRQLELLDGPILAYDDPRRAIGKRVRLEDGRIVAVRLAGETLARDWLKELWLTGRADSELRRWLLAPLGAAPGRPSQGAGGKTLCSCQNVSQQTVLGGIARGLDLDGLKREFGCGTGCGSCVPEIKRLLAAPRPMAANA

SEQ ID NO: 27499 - protein, 816 aa, Pseudomonas aeruginosa
MKKIKLVMVGNGMAGVRTLEELLKLNSDFYDITVFGAEPHPNYNRILLSPVLAGEQTFEEIVLNDLNWYAENGIKLLLDRKVVQIDRVRRRVVAADGSEAEYDRLLLATGSVPFILPIPGNRLQGVIGYRDIADTQAMIDCARTHSHAVVIGGGLLGLEAANGLKQRGMDVTVVHLSDWLLERQLDRTAGKLLQGALEARGIRFRLNTQTQELMDNGSGRVCAVQFNDGDVIPADLVVMAAGIRPNTELAESAGIPCNRGILVNDTLQTYDPRIYAVGECANHRGIAYGLVAPLFEQAKVCANHLAHLGYARYQGSVTSTKLKVTGIDLFSAGDFIGGEGSETITLSDPIGGVYKKLVIKDDVLVGACLYGDTADGGWYFRQIRENHNVAQIRDHLMFGENALGDVGHQGQNSAASMPDTAEVCGCNGVCKGTIVKAIQEHGLFSVDEVKKHTKAASSCGSCAGLVEQILISTVGGAADVKPKSEKAICGCSDLNHGQIRKAIREHRLTSLDAVMRFMDWKTPNGCATCRPALNYYLISTWPGEAKDDPQSRLINERAHANIQKDGTYSVVPRMWGGVTNAAELRRIADVADKYQVPMVKVTGGQRIDLLGVKKDDLPAIWKDLDMPSGHAYGKSIRTVKTCVGSEFCRFGTQNSTQLGIDLEHDLFNMWSPHKVKLAVSGCPRNCAEAGIKDVGIIGVDSGWEMYIGGNGGIKTEVAEFFVKLKTAEEVREYNGAFLQLYREEAFYLERTVHYLQRVGMEHIRKAVVEDAENRKALNDRLQFALSFEQDPWKQRIEQPQLKKEFERIPLKQLENV

SEQ ID NO: 27500 - protein, 121 aa, Kluyveromyces marxianus
GHVDVALPCATQNEVSGAEAEHLVANGVKYVAEGSNMGSTQEAIDIFEGARLKTASATAPAVWYAPGKAANMGGVAVSGLEMAQNSSRVQWTRETVDAELKKIMTTCFDDCVATAQEYSNE

SEQ ID NO: 27501 - protein, 602 aa, Saccharomyces cerevisiae
MPEQEPLSPNGRKRSEVHYISIPLNRGSAFSPDDSVSQFQSDGFMTRRQSILDHPVGSFKGVNSLSRFATSLRRANSFRNIELNADNERSFFKESNDETYDPDTLAPALDGRRLSVTLNNAGRPRITNLANNDRVSTASMAIHDDDYGSIQNSTIGDSGSILRPTASLTEMMSGGAGRRFTNNDMDSIVVKRVEGVDGKVVTLLAGQSTAPQTIFNSINVLIGIGLLALPLGLKYAGWVIGLTMLAIFALATFCTAELLSRCLDTDPTLISYADLGYAAFGTKGRALISALFTLDLLGSGVSLVILFGDSLNALFPQYSTTFFKIVSFFIVTPPVFIPLSVLSNISLLGILSTTGTVLVICCCGLYKSSSPGSLVNPMETSMWPIDLKHLCLSIGLLSACWGGHAVFPNLKTDMRHPDKFKDCLKTTYKITSVTDIGTAVIGFLMFGNLVKDEITKNVLLTEGYPKFVYGLISALMTIIPIAKTPLNARPIVSVLDVLMNVQHIDEAASAIKRRAAKGLQVFNRIFINVVFVLIAINFPEFDKIIAFLGAGLCFTICLILPCWFYLRLCKTTIKPWERVACHVTICISVVLSTLGVGAAIIS

SEQ ID NO: 27502 - protein, 817 aa, Unknown
  Candidatus Kuenenia stuttgartiensis
MNATAVSTKMPGSWKWQVIPVAFLVIWSCIIFVNTLRNNFVYDDSVTIVNNHLIKNWDNFRTLFSFQYFMLSGEISYRPVVTFTYFLDYSLWGENPSGYHFTNLLFHIANVTVFYFFIKKITRIHSLAFISALLFATHPVITETVNSISYREDILAAFFYLMTFILFLKIDDGLKKKGAFYLCYSGSLTFYALSLFSKEMAVTLPVMLVIYTFFFPSKNNPFKECVKKMKGVYIGYFLVTCCYLIIQFWVFKDVSINLSESGQSIFVMFKVLASYIKLLFLPFDLNADYVILPVLADVVSFSISVVLIIVLIIVLLRIGKGNKLFCFFAVWFFVTLSPVSNIIPLSNIMSERYMYIPLMGFSGAVGVLFWKGVSENIFAKICFGVILIVFAFISISRNVVWHDEFALWHDALAREPDSARAHHNLGVVYNSKGMYEKAEYEYKKTLEIKPNDAGAYYNLGNLYERKELIGDAIAAYEKAIQSNPYHADAYNNIGNIYKKKKQYPAAVKMYEKAIRCNPFDFRYHSNLGLIYLETKNYRESVDAFLKALKIAPDKSSTHNSLGNVLKEMGDFDGAEEAYKTALQLDPADANIHNSLGMLYTNMKQFDKAMREFDTAIRLDPKMASAYNNLGIAYANKGDGEKAAEALNTAVALGFDGADVHNNLACVYMTMGMTDNAIRELDIVLEYDQTDCNAHCNLGIAYLSKKNVDKAISEFEEAIKINADDADFHHYLGNALMEKGRYGEAVDAFARAIEINPENSSVHKALGVVYANYFNNTRKALFHLKETLRLNPNQPMAGEIEAAIVTLSGGSDGMAQKP

SEQ ID NO: 27503 - protein, 554 aa, Saccharomyces cerevisiae
MSSLYIKEATGVDELTTAGSQDHPFKTPAYALFASQQKSDATEPKLFVFKTEDNEYQEISASALKKARKGCDGLKKKAVKQKEQELKKQQKEAENAAKQLSALNITIKEDESLPAAIKTRIYDSYSKVGQRVKVSGWIHRLRSNKKVIFVVLRDGSGFIQCVLSGDLALAQQTLDLTLESTVTLYGTIVKLPEGKTAPGGVELNVDYYEVVGLAPGGEDSFTNKIAEGSDPSLLLDQRHLALRGDALSAVMKVRAALLKSVRRVYDEEHLTEVTPPCMVQTQVEGGSTLFKMNYYGEEAYLTQSSQLYLETCLASLGDVYTIQESFRAEKSHTRRHLSEYTHIEAELAFLTFDDLLQHIETLIVKSVQYVLEDPIAGPLVKQLNPNFKAPKAPFMRLQYKDAITWLNEHDIKNEEGEDFKFGDDIAEAAERKMTDTIGVPIFLTRFPVEIKSFYMKRCSDDPRVTESVDVLMPNVGEITGGSMRIDDMDELMAGFKREGIDTDAYYWFIDQRKYGTCPHGGYGIGTERILAWLCDRFTVRDCSLYPRFSGRCKP

SEQ ID NO: 27504 - protein, 439 aa, Fusobacterium nucleatum
MIIFCLLIFKEEFRMSKETLNPLESGQKQVKKACDALGLDPAVYELLKEPQRIIEITIPVKMDDGSIKTFKGYRAAHNDAVGPFKGGIRFHQNVNSDEVKALSLWMSIKCQVTGIPYGGGKGGITVDPSELSQRELEQLSRGWVRGMWKYLGEKVDVPAPDVNTNGQIMAWMQDEYNKLSGEQTIGVFTGKPLSYGGSQGRNEATGFGVAVTMREAFKALGKNLKGATVAVQGFGNVGKFTVKNIMKLGGKVVAVAEFEKGKGAYAIYKDSGFTFEELEAAKAAGSLTKVAGAKELSMDEFWALNVEAIAPCALENAITNHEAELIKAGIVCEGANGPITPEADEVLYKKGIVVTPDVLTNAGGVTVSYFEWVQNIYGYYWTEKEVEEKEERAMVDAFTPIWALKKEFDGKGQPISFRQATYMKSIKRIAEAMKIRGWY

SEQ ID NO: 27505 - protein, 300 aa, Debaryomyces hansenii
MSSSHCRFYENKYPEVDEVVMVNVQEIAEMGAYVKLLEYDNIEGMVLLSELSRRRIRSIQKLIRVGKNEVAVVLRVDKEKGYIDLSKRRVSAEDIVKCDERYNKSKAVHSILRHCAEKFTISLETLYQSIGWPLSRRYGHAYDALKLSITDPTIFDDIEAPSPDVLEELKLYISRRLTPQAIKIRADVEVSCFSYEGIDAIKKALTAAEEISTEQMAVKAKLVAAPLYVISVQALDKNQGIALLEKAIEKVSESIENSGGICKVTMSPKAVTATEDAELQALLERKEAEDKESSDEEEED

SEQ ID NO: 27506 - protein, 304 aa, Saccharomyces cerevisiae
MSTSHCRFYENKYPEIDDIVMVNVQQIAEMGAYVKLLEYDNIEGMILLSELSRRRIRSIQKLIRVGKNDVAVVLRVDKEKGYIDLSKRRVSSEDIIKCEEKYQKSKTVHSILRYCAEKFQIPLEELYKTIAWPLSRKFGHAYEAFKLSIIDETVWEGIEPPSKDVLDELKNYISKRLTPQAVKIRADVEVSCFSYEGIDAIKDALKSAEDMSTEQMQVKVKLVAAPLYVLTTQALDKQKGIEQLESAIEKITEVITKYGGVCNITMPPKAVTATEDAELQALLESKELDNRSDSEDDEDESDDE

SEQ ID NO: 27507 - protein, 525 aa, Phaseolus vulgaris
MASSSVTLKANAHLANSEKGHLFRQESSFLGERVKVGPNNSAFVTNQLARCSRSQKRVNHGVASAILTSNDAKESLSLQVPSFMRRRVDPKNVVSIILGGGPGKQLFPLTQRAATPAVPVGGCYRLIDIPMSNCINSGINKIFVLTQFNSASLNRHIARTYFGNGINFGDGTVEVLAATQTPGEAGKKWFQGTADAVRQFTWVFEDAKNTHVENVLILAGDHLYRMDYMDLIQSHVDRNADITVSCAAVGNSRASDYGLVKVDDRGRIIQFSEKPKGDDMTAMQADTSLLGLSPPDALKSPYIASMGVYVFKTDVLLNLLKCRHPTSNDFGSEIIPAAVRDHNVQSYFFRDYWEDIGTIKSFYDANLALTEESHEFEFYDPKTPIYTSPGFLPPTKIDKSRIVDAIISHGCFLRECTVQHSIVGERSRLDYGVEIQDTVMMGADYYQTESEIASLLAEGKVPIGIGRNTKIRNCIIDKNAKIGKDVIIKNKDDVQEADRPEDGFYIRSGITIIAEKATIEDGTVI

SEQ ID NO: 27508 - protein, 154 aa, Saccharophagus degradans
MKSRTGALPSRKQIALIAHDNKKQELSDWVCTHKKELEQHDLFATGTTGYKLAAETGLKVEKYISGPLGGDQQIGAKISTGEIDVLIFFWDPFEPMPHDPDVKALLRIAAVWNIPVACNPASADFVITSPLIKQSYERQIPDYEAYIAERTKKL

SEQ ID NO: 27509 - protein, 152 aa, Oryza sativa
MAGRGEMPMRPVRPGPPMQYRGPPPMARARVEPVDREKTCPLLLRVFTKVGGHHQNEEFAVRGKEPKDEVQIYTWKDATLRELTDLVKEVALAARKRNARLSFAFVYPDKHGRFVVKEVGSTFSYGHGRGDDAKTLAELGFQIGDYLSVAIY

SEQ ID NO: 27510 - protein, 238 aa, Medicago truncatula
MLRFLNGLKQLCLAVVNWCNTELSSPEQPPPHGGFNNAEEISNETVFTVSDVEALYELFKQISSAVVDDGLITKEDFQLALFKTSSKRSLSAERVFDMFDTNSHGVLNFKEFASAMSIFHPIAPVDDKIEFLFRLYDLKQQGYIDREQLKEMVVATLSESGVQLSDYVINRIIDKTFEDADRNHDGKIDKEEFYNLALRHPSLLKNMSLLYLTEITTKFPSFVFHSQVEDTEASALSC

SEQ ID NO: 27511 - protein, 248 aa, Unknown
  Oceanospirillum sp. MED92
MLMNTATSLTLIDKKYLSPRSLELSYQSDKPLKYLAGQFYSLRFPCGDGFKSRSYSVVNNKRADQNEEFTLSFVITLVEGGAASEYFRSAKPGSEIEASGPFGNLVLPRSNPKRFILIATGAGVAPYRSMLDELTNRLHAEPELKTELILGVRNREELLYGEEFKALSAREERFGFNAVFSRENNNLAEGEFSGHVTELYTLLEASPNDDMIYLCGHPQMIDDSVSFFENLGFSAANLKREKYLFSAI

SEQ ID NO: 27512 - protein, 406 aa, Nicotiana tabacum
MLEAPKFVELIDLNQNLSQNFYHKLGEGSNMSTESYGSLQMSSGGGSVAMSMDNSSVGSNDSHTRILNHQSLNRVHNNYSVAASVNRVRVSNGLSNDALAQALIDPRFPTIGLENYDEWTIDLRKLNMGPAFAQGAFGKLYKGTYNGEDVAIKLLERPEHDLERAHLMEQQFQQEVMMLANLKHPNIVRFIGACRKPMVWCIVTEYAKGGSVRQFLTRRHNRSVPLKLAVKQALDVARGMEYVHALNLIHRDLKSDNLLIAADKSIKIADFGVARIEVQTEGMTPETGTYRWMAPEMIQHRPYTQKVDVYSFGIVLWELITGMLPFQNMTAVQAAFAVVNKGVRPTIPNDCLPVLSEIMTRCWDADPDNRPPFSQVVRMLEAAETEIMTTVRKARFRCCIQPMTTD

SEQ ID NO: 27513 - protein, 224 aa, Medicago truncatula
MTCCFKQLWHAVANWCNTEVSKRPPSGLKNPEAISRESVFTVSEVEALYELFKKISSAVVDDGLITKEEFQLALFKTSNKRSLFAERVFDMFDTNSHGALDFKEFASALSVFHPIAPIDDKIEFLFRVYDLKQQGYIERDELKQLVVATLSESDMELSDEMINGIIDKTFEEVDTNHDGKIDKEEWKNLAMQQPSLLTNMTLPYLTEITTAFPSFIFHTQVDDN

SEQ ID NO: 27514 - protein, 53 aa, Triticum aestivum
  misc_feature (6)..(6): Xaa can be any naturally occurring amino acid
  misc_feature (21)..(21): Xaa can be any naturally occurring amino acid
  misc_feature (27)..(27): Xaa can be any naturally occurring amino acid
  misc_feature (32)..(32): Xaa can be any naturally occurring amino acid
  misc_feature (35)..(35): Xaa can be any naturally occurring amino acid
GDERAXEFAGILKSNDPVGFXLVDVLXWGSIXHIXAYYILATTSNGYDPPFFG

SEQ ID NO: 27515 - protein, 184 aa, Medicago truncatula
SVSEVEALYELFKKISSGVVDDGLITKEEFQLALFKTSNKRSLFAERVFDMFDTNSHGVLDFKEFASALSIFHPIAPIDDKIDFLFRLYDLKQQGYIDRERLKQMVVATLSEFGMRLTEEMLNSIMDKTFEEVDTNHDGKIDREEWKNLAMQQTSLLKNMTLPYLTEITTTFPSFIFHTQVDDD

SEQ ID NO: 27516 - protein, 658 aa, Arabidopsis thaliana
MSYYSSFFFLFLFSFLTSFRVSAQDPTYVYHTCQNTANYTSNSTYNNNLKTLLASLSSRNASYSTGFQNATVGQAPDRVTGLFNCRGDVSTEVCRRCVSFAVNDTLTRCPNQKEATLYYDECVLRYSNQNILSTLITTGGVILVNTRNVTSNQLDLLSDLVLPTLNQAATVALNSSKKFGTRKNNFTALQSFYGLVQCTPDLTRQDCSRCLQLVINQIPTDRIGARIINPSCTSRYEIYAFYTESAVPPPPPPPSICTPPVSAPPRSGKDGNSKVLVIAIVVPIIVAVLLFIAGYCFLTRRARKSYYTPSAFAGDDITTADSLQLDYRTIQTATDDFVESNKIGQGGFGEVYKGTLSDGTEVAVKRLSKSSGQGEVEFKNEVVLVAKLQHRNLVRLLGFCLDGEERVLVYEYVPNKSLDYFLFDPAKKGQLDWTRRYKIIGGVARGILYLHQDSRLTIIHRDLKASNILLDADMNPKIADFGMARIFGLDQTEENTSRIVGTYGYMSPEYAMHGQYSMKSDVYSFGVLVLEIISGKKNSSFYQTDGAHDLVSYAWGLWSNGRPLELVDPAIVENCQRNEVVRCVHIGLLCVQEDPAERPTLSTIVLMLTSNTVTLPVPRQPGLFFQSRIGKDPLDTDTTSKSLLGSVDDASITDIHPR

SEQ ID NO: 27517 - protein, 570 aa, Gluconobacter oxydans
MASATQTPTANHGTEDFAALLEETLGRDTGFDGSVVTGRVVRLTDEFAIVDVGLKSEGRVSLKEFGPAGVAPDVKPGDVVELYVERYEDRDGSIVLSREKARREEAWTALERAFANNQRVNGTIYGRVKGGFTVDLGGAMAFLPGSQVDIRPVRDVGPLMGQPQPFQILKMDRARGNIVVSRRAVLEETRAEQRSELIQGLKEGMILDGVVKNITDYGAFVDLGGVDGLLHVTDIAWKRINHPSEALQIGQPVRVQVIRFNPDTQRISLGMKQLEADPWENVAIKYPAGARFTGRVTNITDYGAFVELEPGVEGLVHVSEMSWTKKNVHPGKIVATSQEVDVMVLDVDSAKRRISLGLKQVQRNPWEQFEEEHKVGSIIEGEIRNITEFGLFVGLSADIDGMVHMSDLSWDEPGEAAMSHYEKGQVVKAKVLDVDPEKERISLGIKQLQEDPAADTLSRVQKGAVVTCVVTAVQSNGIEVKVDDVLTGFIRRAELARDKAEQRPERFAVGEKVDAKVVSVDRASRKLALTIRGREVEEDKQAINEYGSSDSGASLGDILGAAIRRRNTDA

SEQ ID NO: 27518 - protein, 455 aa, Medicago truncatula
MAVYLIRSCSWLLIVLTLFIHADCGDIVKTLPGFPGELPFTLETGYIGVEHSELFYLFVESTGNPKTDPLLLYLIGGPGCSALNAFFFQVGPLAFNEADYTGGLPQLILRSYPWTKSASIIFLDAPVGTGYSYSTSPESLVPSDSMSARQTYKFLRQWLMEHPQYLLNPVLIVGDSYSGMLAPIISKHILDGNAAGPKPYITLIGMIGGSPVTSIALENNTKIIMAHRLTLISDSLYEEAKESCEGWYIDVNPSNTKCVKALQEIDELLTDINVANVLDPNCERLSPKPNDTRSRRVLKGKETNFQWQFQKQHHQKWWCKSYVYLLSYIWANDEKVQEALHVREDIYNKDISDAIDYQKNLTQTNLKVLLYNGDHDLVVSHISTETWIGTLHLTVEDPWRPWFVDGQVAGYQVQYSNIGYRLTYATVKGAGHSPTEYNNRECFEMFERWIHFYPL

SEQ ID NO: 27519 - protein, 245 aa, Coccidioides immitis
MAVTLGPSSPDADIHPIATGPAKEVVEKHSIQKTWIVLEEKQIPYQYIEVNASLDPSSLLSLNPRGPIPTLYCPQPNGSKPLYESNIINEYLDDVFSSHQPHLFPLDPYKKARAKTWVDFVTSRIIPSFNRFLQAQGEGEIAKAHNEFLGHLKEFIDAMDSSGPYFFGEDFTMPDVALAPWAMRLWLLDHLKGGLRIPEPGEGGEDEQVWERWREWVDAVGSRNSVANTLSEKEYYLPIYKKVCR

SEQ ID NO: 27520 - protein, 475 aa, Medicago truncatula
MGSSPNSKPKIVRGSAGYILEDVPHLTDYIPELPTYSNPLQDNPAYSVVKQYFVHIDDSVPQKIIANKDSPRGIHFRRAGPRQKVYFKSDEVQAAIVTCGGLCPGLNTVIRELVCGLYHMYGVKKVLGISGGYKGFYAHNTISLTPKTVNDIHKRGGTILGSSRGGHDTTKIVDSIQDRGINQVYIIGGDGTQRGAYRIFEEIRNRGLKVAVVGIPKTIDNDIPVIDKSFGFDTAVEEAQRAINAAHVEAESVENGIGVVKLMGRYSGFIAMYATLANRDVDCCLIPETPFFLEGPGGLFEYTERRLKENGHMVIVIAEGAGQELVTESIQSMHKQQDASGNKLLQDVGLWISHKLKDYFAKQKTMGITLKYIDPTYMIRAVPSNASDNVYCTLLAQSAVHGAMAGYTGFTSGLVHGRQAYIPFNRINEGQNTVVITDRMWARLLSSTNQPSFLIAKTAVEEKKKEEEEEDSFNL

SEQ ID NO: 27521 - protein, 239 aa, Zea mays
MAAAGGGVGDSELRLLGKSSSPWVFRVRVALGLRGLSYEYIEEDLGNKSELLLRSNPVHKKVPVLIHGGRPVCESLVILQYVDEAWPTAGPPLLPADPYDRATARFWAAYINDTFFPAFRALFRSLTDEQRAEALRNALPAVETLERTLAECSAGKAFFGGDAVGIVDVALGSHLVWIRVVDEVGGTSLLDAAKVPGLAAWAERFLAVDAVKKVMPDATKVLEQYKGFRAKWIAAAGST

SEQ ID NO: 27522 - protein, 188 aa, Triticum aestivum
MIISKKNRNEICKYLFQEGVLYAKKDYNLAKHPQIDVPNLQVIKLMQSFKSKEYVRETFSWQHYYWYLTNDGIEFLRNFLNLPSEIVPATLKKSARPPGRPLGSGPPGDRPRGPPRFEGDRPRYGDRDGYRGGPRGAPGDFGGEKGGAPAEFQPSFRSSGGGGFGRGGGGGFGRGGGGGGGFGTSPME

SEQ ID NO: 27523 - protein, 552 aa, Buchnera aphidicola
MKKINPNNTESWKMLQNHFYEIKSFHIKELFKKDKNRFKKFSLKFDNRILVDYSKNRITSFTIKLLLKLANEMDLNNSIKSMFSGKIINETENRAVLHTALRNRSNSSIIHNGCNIMFDINKVLEKMKHFSNLVINRKWLGYTGKYITDIVNIGIGGSDLGPKMVIKALNSYRNHLNIHFVSNVDGANIFNVLKKLNPESTLFIIVSKTFTTQETIVNANTAKKWMLNAVNKNEFLDQHFIAVTTNAQEAMNFGIRYKNIFLFWDWVGGRFSLWSSVGLSIVLAVGFKNFEQLLDGAYMMDQHYLHTKFDNNIPVLLALIGVWYNNFFKSETEAIFFYDWNMNYFSSFLQQMNMESNGKNICRSGEFVNWQTGPIIWGEPGTNGQHAFYQLLHQGTKLIPSDFIISIIPKHPFKDHHKYLLSHFFAQTQALAFGKFNQKCNVHINDKKTFDERLSSISFHKVCKGNQPSNSIVLDQLNPYNLGILIALYEHKVFTQGVIFNIFSFDQWGVELGKLLAKEIFLNMNTTGSKNYEYDSSTNGLINFYKIHSNNT

SEQ ID NO: 27524 - protein, 433 aa, Burkholderia vietnamiensis
MSSEPVFSSSLPDIDAHLGVAVIGGGQAGLSISYYLKQAGIDHLVFEKETVTHTWRKQRWDAFCLVTPNWQCALPGYPYRGADPHGFMTKDEIVEYLDGFIRSVDAPVLEHTAVEHVTRDADGRYRIATSRGTYMADRVVVASGGYHRPIVPRMAERLPASIVQLQSSEYRNPAALPDGPVLVVGSGQSGAQIAEDLHLAGRKVLLAVGDAPRCARFYRGRDVVDWLADMQYYDMPVDAHPLREGVRDNTNHYVTGRDGGRDIDLRRFAAEGMELYGRLEDFSGGQLRFSADLSAQLDSADDTYNRINAGIDAHIEKNGIAAPPATRYEPVWRPDHERTTLDLAASGIASVIWCIGFTPDFNWLDAPVFNGRGYPAHRRGVTPVPGLYFVGLPWLYTWGSGRFSGVARDAAHIVDRIQAEMTAARRSAESEVA

SEQ ID NO: 27525 - protein, 189 aa, Rhodopseudomonas palustris
MTLAIEDRLRSASPAEFAHAMRQLASGVSVITAGKGSTRVGMTATAVTSLSATPPTLIVCLNQKSSAGPLIACSHAFAVNILAADQIEIGERFAGKGGLKGAARFAGGTWNTGISGAPVLAGALANIECELDEVIERHTHAILVGRVVHTSTLPRKASLTYWQGSYVAIDRDEDLVRLAEVSVPSAKHG

SEQ ID NO: 27526 - protein, 442 aa, Robiginitalea biformata
MSLPKPQLSFWQIFNMNVGFLGIQYSFGLQQSAINPIFLFLGASEELLPILNIAGPVTGLIVQPIIGAISDKTWSPRWGRRKPFFLIGALIGSICLFLFPLSPALWFAVGLLWLLDVGNNMAMEPYRAFVGDKLPDKQMSLGYQMQSLFVGAGILLANASIFLFQDWFGGGEELTGSVPKWLYYSFFIGSFLSLATILWSVLKTPEIPPDAKELAEINRHKALPFAQRLKVPFVEIAEAVRDMPKFMWKLAGVYLFQWYALFVYWQFITPLFRTTMGFDTSQAAAQAAKMSTTYNIVTALVALVLVPLTMRFGGKKVYALSLFGTAVALFWIPFIDDPVNVLFPMILFGIGWAAMMGIPYSMVSKIVPQDRRGVYMGILNMMIVIPMGIETLSFGAIFSNFLGSDSVNAMLFAGAFFAIAGLLALRLNVAKARAEVAEVMGE

SEQ ID NO: 27527 - protein, 463 aa, Unknown
  Burkholderia sp. 383
MSGSNTGLGTGLKQRHVTMMSIAGVIGAGLFVGSGHAIAEAGPASILAYAIAGVLVVLVMRMLGEMAVAHPDSGSFSTYADRAIGHWAGFSIGWLYWWFWVLVIPIEATAAATILNAWFPGVATWAFALGITLVLTVTNLFSVKNYGEFEFWFALIKVVAIVVFLCIGGAAIVGIIPAPAVSGVSNLFVHDGFMPHGAGAVLAAMLTTMFSFLGTEIVTIAAAESDNPQRQIVRATNSVIWRITLFYLGSILVVAAIVPWNDPLLPKHGSYQRAMELIGIPNAKAIIDVIVLVSVASCLNSALYTASRMLFSLSKRKDAPAFLHRTDSTGTPRAAVLASTAFGFVTVIANYLMPEQVFGFLLATSGAIALLVYLVIAISQLRMRKTLESTGADLTLRMWLFPWLTWLVIVFICGTLTVMLVSEDHRMEVGATAVLALIVLLASWLNKRGRDAQASEGRRASAM

SEQ ID NO: 27528 - protein, 431 aa, Triticum aestivum
  misc_feature (23)..(23): Xaa can be any naturally occurring amino acid
VSSGDGAGGGAGDAVPGGRAGQXAVPARQPAGRVWGVRRTARATSGFKVLALGPETTGVIQRMQQLLDMDTTPFTDKIIAEYIWVGGSGIDLRSKSRTISKPVEDPSELPKWNYDGSSTGQAPGEDSEVILYPQAIFKDPFRGGNNILVICVTYTPQGEPIPTNKRHMAAQIFSDPKVTSQVPWFGIEQEYTLMQRDVNWPLGWPVGGYPGPQGPYYCAVGSDKSFGRGISDAHYKACLYAGIEISGTNGEVMPGQWEYQVGPSVGIDAGDHIWASRYILERITEQAGVVLTLDPKPIQGDWNGAGCHTNYSTLSMREDGGFDVIKKAILNLSLRHDLHIAAYGEGNERRLTGLHETASISDFSWGVANRGCSIRVGRETEAKGKGYLEDRRPASNMDPYTVTALLAETTILWEPTLEAEALAAKKLALKV

SEQ ID NO: 27529 - protein, 435 aa, Zea mays
MGMVGGSQVSCHLNSRQPSCFPQAQAVTIDFARATNLLVITPTYSTSTLGVHRRYLSLHHRERRGNFCLFMPALDLAGGTLDERAWALQRAAYDGGPGGGALGTPEFVFLAHVVDMMSSMHVPFALRSLSSTPFANHFILLPFWPVAFGFMLLMWCCSKTFVVSFYCLRGHLHQTWSVPRYGFQYFLPAAKKGINQQIELAILRADRMGVKVLSLAALNKNEALNGGGTLFVNKHPDLRVRVVHGNTLTAAVILNEIPSNVREVFLTGATSKLGRAIALYLCRKKIRVLMFTVSSERFVKIQREAPPEYQQYLVQVTKYQAAQNCKTWIVGKWLSPREQRWAPSGTHFHQFVVPPIIGFRRDCTYGKLAAMRLPKDVQGLSSCEYTMERGVVHACHAGGVVHFLEGWGHHEVGAIDVDRIDVVWKAALKHGLAPV

SEQ ID NO: 27530 - protein, 335 aa, Arabidopsis thaliana
MFTLVELKTATKNFRPESVIGEGGFGQVFKGWVDEKTLAPSRAGVGIPVAVKKSNPDSEQGLHEWQCEVRFLGKFHHPNLVKLLGYCWEENQFLLVYEYLPKGSLENHLFSKGAEALPWDTRLKIAIEAAQGLTFLHNSEKSVIYRDFKASNILLDSNFHAKLSDFGLAKNGPINGFSHVTTRVMGTQGYAAPEYMATGHLYVRSDVYGFGVVLLELLTGLRALDPNRPSAQQNLVEWAKPGLNQKKKVQKMMDPRLEQKYPLLAVTKTAELILRCLEADPKNRPPMDDVLRELEVVRTIRDQPQEERRKRSSGPDTNRVRGNDSPYGRRTGRTG

SEQ ID NO: 27531 - protein, 1438 aa, Debaryomyces hansenii
MVNSSNGSNPLSASSTDLNSAQQQYTNVNNPVSNANHSHRHTAGPKGRRPSLLRNDSSSNSVYTPSNTAGDGSTPMHSSHLKWGSSGTGNNNASSTAINDSHNSTNANSTSLLTPSSNKRQTSHNNSGNNTLSSTGGRARSRSITQTLSHNLQNNNKQYLSQEKAYLKKMKNQFVDDYYTKGITGAEMKEVNNNDEDEDEDEDETNPNGHSDLLADMDDDKYQIDYNLAFTLLKNGKNAININPNRNITQLNADSADDPAVIERLEWQSMLTSVLTGDVVRSEKTKIINNNSPENEQSSFLHATYKENLWFGIHAKLFNRTEDDQRKIIEYRRTLADALFDEVLNFEVNHDDPESNPPRNQVAYILDKYDKCCDLWRTLEDMKNEKPVCRTAEFQDRIDALTAWLSITDAMQRESDSLKVWIGNDEMDITKSRSESGSAPSSEATTPTNTKKIFNEDNKSLAERLMKEKDVYSIFQKRIFFPLAPWMIKSKDTYLRLGHIFETLKLPDYIHDLIQLCLIPMKLIKEIINVRLVYAKKLENPTLMMIDQMIDDFKSYITIALEVKLGIVEYCRPDVGQIWVLSDLFDSENQEFDKVVLKCVKYFFALLNKKLLDSSRSPTNFRTFKEPEELEETWNYLKWLGNLIDGGSVVVAEHITVLTLKLIHRLLAYFNNQIGTPPAKSAGSSDLIRWYSSTTENFGQLRRKLARFTGEISRDFTNSLVFDLSSTPSNRTKNILEVLKSTNHFLVYTGTIETQGTYFFASAELMGNEQEILRIINGSYIGSDPNEANLDFSDLLKMLQLHEDGETDQHPDLVDHLIPNESSDFGYVLALCPPKPIVWEGHIVTIHLENVPITDIKVGQILMITKLPYGSLHMVKEKFLDTVNDFILVGGMMKQVEQRCSLAKVHHELTKINRVFFKMSLSVLDSVKKVRANCKELAAESSCQELINSYFIYARDFGKNSVKNLDSSRKSTVIMKLIQLSIEWVSFVCDDCIPTDRRTFRSCVLALEFAMDMTRGFNVLVLNDEQFYKLKLKVARCMSLLISHFDIMGARSSEAEKKKLLKWSSQRHRIENSADDACIIQAYREDVMREIEEIENYRKDLQEQLLSIGRVLDVTDLEYQFVTLLASSFSSVSIRWQKGRFIGGGTFGHVYAAVNLDTGGVMAVKEIRFHDSQSVKNIVPSIKDEMTILEMLNHPNVVQYFGVEVHRHKVYIFMEFCEGGSLAGLLTHGRIEDEMVIQVYTLQMLEGLAYLHQSGVARRDIKPENILLDHNGVIKFVDFGAAKVIATSGRTLGGGSGGANQGRSMNGTNLNSMTGTPMYMSPEVITGASGSGNGVVDIWSLGCCVLEMATGRRPWTNLDNEWAIMYHIAAGHKPQLPSADQLSEPGRKFISRCLEHDPSNRPGAVELLNDPWIVAIRQAAFVSSDSVSTPSSEVGSDM

SEQ ID NO: 27532 - protein, 711 aa, Neisseria meningitidis
MKGTIMFNKHVKTFQYGNQTVTLETGEIARQAAAAVKVSMGDTVVLVAVTTNKEVKEGQDFFPLTVDYLERTYAAGKIPGGFFKREGKQSEKEILTSRLIDRPIRPLFPEGFYHDIQIVAMVVSVDPEIDSDIPAMLGASAALVLSGVPFAGPIGAARVGYVNGVYVLNPTKAELAKSQLDLVVAGTSKAVLMVESEAKILPEDVMLGAVVYGHDQMQVAINAINEFADEVNPELWDWKAPETNEELVAKVRGIAGETIKEAFKIRQKQARSAKLDEAWNAVKEALITEETDTLAANEIKGIFKHLEADVVRSQILDGQPRIDGRDTRTVRPLNIQTSVLPRTHGSALFTRGETQALAVATLGTSRDEQIIDALSGEYTDRFMLHYNFPPYSTGEVGRMGAPKRREIGHGRLAKRALLAVLPKPEDFSYTMRVVSEITESNGSSSMASVCGGCLSLLSAGVPLKAHVAGIAMGLILEGNKFAVLTDILGDEDHLGDMDFKVAGTTEGVTALQMDIKIQGITKEIMQIALAQAKEARLHILDQMKAAVAGPQELSAHAPRLFTMKINQDKIREVIGKGGETIRSITAETGTEINIAEDGTITIAATTQEAGDAAKKRIEQITAEVEVGKVYEGTVVKILDNNVGAIVSVMPGKDGLVHISQIAHERVRNVGDYLQVGQVVNVKALEVDDRGRVRLSIKALLDAPAREENAAE

SEQ ID NO: 27533 - protein, 270 aa, Leifsonia xyli
MTIDDRGQIRSARRIVVKVGSSSISGENAGQIGPLVDALAEAHGRGSQVVLVSSGAIATGIPYLALTERPKDLATQQAAAAVGQNVLIYRYQDSLDRYGIVAGQVLLTARDVENPTHRSNAKRAMERLLDLRILPIVNENDTVATHEIRFGDNDRLAALVAKLVEADLLVLLSDVDALYTKPPQESGAERIAHVGWNDQLEGVEIGSAGPSGVGTGGALTKVSAARQAAEHGTAVVLTATSLVVDALRGEPVGTWFAPAQETAVESAPAS

SEQ ID NO: 27534 - protein, 691 aa, Zea mays
MEASSGSSPPHSQENPPEHGGDMGGAPAEEIGGEAADDFMFAEDTFPSLPDFPCLSSPSSSTFSSNSSSNSSSAYTNTAGRAGGEPSEPASAGEGFDALDDIDQLLDFASLSMPWDSEPFPGVSMMLENAMSAPPQPVGDGMSEEKAVPEGTTGGEEACMDASEGEELPRFFMEWLTSNRENISAEDLRGIRLRRSTIEAAAARLGGGRQGTMQLLKLILTWVQNHHLQRKRPRDVMEEEAGLHVQLPSPVANPPGYEFPAGGQDMAAGGGTSWMPHQQAFTPPAAYGGDAVYPSAAGQQYSFHQGPSTSSVVVNSQPFSPPPVGDMHGANMAWPQQYVPFPPPGASTGSYPMPQPFSPGFGGQYAGAGAGHLSVAPQRMAGVEASATKEARKKRMARQRRLSCLQQQRSQQLSLGQIQTSVHLQEPSPRSTHSGPVTPSAGGWGFWSPSSQQQVQNPLSKSNSSRAPPSSLEAAAAAPQTKPAPAGARQDDIHHRLAAASDKRQGAKADKNLRFLLQKVLKQSDVGSLGRIVLPKKEAEVHLPELKTRDGISIPMEDIGTSRVWNMRYRFWPNNKSRMYLLENTGEFVRSNELQEGDFIVIYSDVKSGKYLIRGVKVRPPPAQEQGSGSSGGGKHRPLCPAGPERAAAAGAPEDAVVDGVSGACKGRSPEGVRRVRQQGAGAMSQMAVSI

SEQ ID NO: 27535 - protein, 334 aa, Burkholderia mallei
MNGTQRFPMDIPFGWFCIGYSDEVAVGDVKPLRYFGKDLVMFRGESGEIGVLDAYCPHLGAHMGHGGTVEGDSLRCPFHHWAYRKDGFCTSIPYAKEMPLIAKREPIAVPYPVVERNGAIWVWHHPQQIAPTYEVLEHEEFVAPGWSKPVRRFWSFASNPQEIAENGVDTAHFKCIHHMDAMPEGEVTYEGHIRRSRTTGETSMIFPDGVTRTVETGTNVINSGAGQKISRFTGFVTISLMEMATPVEADQVELRFCFAFPECPEGSPEWQGAMNTIDYFSGQLGIEGGDIPIWSHKIHREKPILCDGDGAIMRFRRYFEQFYAPRVVPVTASA

SEQ ID NO: 27536 - protein, 421 aa, Leifsonia xyli
MSPTSTATSLTDRFSAAKRASIALAIASNAEKDAALRGIAEGVLAAADSILAANAVDLATGRENGLSTGLLDRLTLTPARLQGLADAVLEIVALTDPVGQTVRGSALPNGVKITQIRVPFGVVGAIYEARPNVTIDIAALALKSGNAAVLRGGSAAIATNGVLVGVIQEALAAAGLPADAVQTIDDFGREGANGLMQARGFVDVLIPRGSAGLIQIVVTQSAVPVIETGAGVVHIVLDESAREDWAVDIVRNAKAQRPSACNAVETVLVLRAAAERLLSPVLGALTEAGVTIHADEIALPHSPGAIAVTAEDYATEHMSLDVSVRVVDDLDAAIEHIRTHSTQHTEAIVTNDLANAERFLNEVDSAVVMVNASTRFTDGGEFGFGAEVGISTQKLHARGPMGLPELTSTKWIVRGAGQVRS

SEQ ID NO: 27537 - protein, 312 aa, Helicobacter pylori
MEIAVFGGGAWGRALAFAFGEKNEVKIISRRDLNEPLKKLNDALISKGSAPIEQVDLERGLKAALYVIAISVQHLREWFQNASLPKNAKVLIASKGIEVLNKAFVSEIAKDFIDPNALCFLAGPSFAAEIIQGLPCALVIHSNNQALALEFANKTPSFIRAYAQQDIIGGEIAGAYKNVIAIAGGVCDGLKLGNSAKASLLSRGLVEMQRFGAFFGGKTETFLGLSGAGDLFLTANSILSRNYRVGLGLAQNKPLEVVLEELGEVAEGVKTTNAIVEIARKYGIYTPIASELALLLKGKSVLESMNDLIRRA

SEQ ID NO: 27538 - protein, 680 aa, Arabidopsis thaliana
  misc_feature (652)..(652): Xaa can be any naturally occurring amino acid
  misc_feature (672)..(672): Xaa can be any naturally occurring amino acid
MSFFWLFPFLLHLSFADSLSPLSAPVQNFIHLNHSCPSSILTYSRNSTYFTNLKTLLSSLSSRNASYSTGFQTATAGQAPDRVTGLFLCRGDVSQEVCRNCVAFSVKETLYWCPYNKEVVLYYDECMLRYSHRNILSTVTYDGSAILLNGANISSSNQNQVDEFRDLVSSTLNLAAVEAANSSKKFYTRKVITPQPLYLLVQCTPDLTRQDCLRCLQKSIKGMSLYRIGGRFFYPSCNSRYENYSFYNETATRSSSPPSLPPRSTPQQQLKLAPPPLISERGKGRNSSVIIVVVVPIIALLLLFVAFFSLRAKKTRTNYEREPLTEESDDITTAGSLQFDFKAIEAATNKFCETNKLGQGGFGEVYKGIFPSGVQVAVKRLSKTSGQGEREFANEVIVVAKLQHRNLVRLLGFCLERDERILVYEFVPNKSLDYFIFDSTMQSLLDWTRRYKIIGGIARGILYLHQDSRLTIIHRDLKAGNILLGDDMNAKIADFGMARIFGMDQTEANTRRIVGTYGYMSPEYAMYGQFSMKSDVYSFGVLVLEIISGKKNSNVYQMDGTSAGNLVTYTWRLWSNGSPLELVDPSFRDNYRINEVSRCIHIALLCVQEEAEDRPTMSAIVQMLTTSSIALAVPQRPGFFFRSSKHEQVGYXGLVDRLSINTSALCSVDDAXSITNVAPR

SEQ ID NO: 27539 - protein, 328 aa, Neisseria meningitidis
MPMGIAPYCRNLIIQEQKMKIANSITELIGNTPLVKLNRLTEGLKAEVAVKLEFFNPGSSVKDRIAEAMIEGAEKAGKINKNTVIVEATSGNTGVGLAMVCAARGYKLAITMPESMSKERKMLLRAFGAELILTPAAEGMAGAIAKAKSLVDAHPDTYFMPRQFDNEANPEVHRKTTAEEIWRDTDGKVDVFVAGVGTGGTITGVGEVLKKYKPEVKVVAVEPEASPVLSGGEKGPHPIQGIGAGFIPTVLNTKIYDSITKVSNEAAFETARAIAEKEGILVGISSGAAVWSALQLAKQPENEGKLIVVLLPSYGERYLSTPLFADLA

SEQ ID NO: 27540 - protein, 1108 aa, Pseudomonas syringae
MAKKPGDATFIKDPLWYKDAVIYQVHVKSFFDSNNDGIGDFAGLIEKLDYIAALGVNTIWLLPFYPSPRRDDGYDISEYRDVHSDYGTMADAKRFIAQAHKRGLRVISELVINHTSDQHPWFQKARHAKPGSKARDFYVWSDTDQKYDGTRIIFLDTETSNWTWDPVAGQYFWHRFYSHQPDLNFDNPHVLDAVLEVMRFWLDLGIDGLRLDAIPYLIERDGTNNENLPETHQVLKRIRAEIDANYPDRMLLAEANQWPEDTQLYFGDSKGPDGDECHMAFHFPLMPRMYMALAQEDRFPITDILRQTPEIPENCQWAIFLRNHDELTLEMVTDRERDYLWNYYAADRRARINLGIRRRLAPLVDRDRRRVELLNSMLLSMPGTPTLYYGDEIGMGDNIYLGDRDGVRTPMQWSIDRNGGFSRADPASLVLPPIMDPMYGFQSVNVEIQERDPHSLLNWNRRMLAVRKQQKAFGRGTLKMLSPSNRRILAYTREYTAPDGHSEVVLCVANVSSAAQAAELELSAYAGTVPVEMLGGSAFPPIGQLSYLLTLPPYGFYWFLLASENQMPSWHVEPAQSMPDFPTLVLKKRLEELLEEPLRSTMEKTSLAVYLPKRRWFAGKGKDIEQVNIAYAVRFGDEAHPVLLSEIEVTADGQTDRYQLPFGLLAEDDISSALPQQLALARVRRNRDVGLITDAFTLETFIRAVILGMQSDTVIPCADGELRFEQSSQLAPLALTAESEVRYLSAEQSNSSAVVGGSLVLKLIRKVSAGTHPELEMGAFLTNAGFKNISPLLGSVVRVGNDGKPNLLMIAQGYLSNQGDAWEWTQNNLERAVRDELAHGVSGQEQHYNALLELADFSRSLGQRLGEMHQILASPTDNSDFAVEVTSSQDSKASGTSVNAQLERALQLLEQRKGDLEQDDQQLVSDLLAQRKQIRRRVEGLAKRSAGGLRIRVHGDLHLGQVLVVKGDAYLIDFEGEPARALEERRAKHSPFKDVSGVLRSFDYAAAMAVRSAQNVDTSPEAAGARKRVAETYLAQAREAFIEGYRSATSGMAHAWKDAKGEDAALELFTLEKAAYEVIYEAENRPAWLAVPLQGLRGLLQPSDGEPI

SEQ ID NO: 27541 - protein, 161 aa, Triticum aestivum
  misc_feature (87)..(88): Xaa can be any naturally occurring amino acid
  misc_feature (108)..(108): Xaa can be any naturally occurring amino acid
MAAKAVQWPVMVVVVIMAVMAARVGADMDADRSECAEQLVGLAPCLQYVQGQARSPAPDCCGGLSQVLDKSPKCLCVLVKDKDDPNXXIKINASLALALPSACGNTKXNVSHCPPNTASTNSRAQTSAGTASSTATAGVALGVLAGYLALLLPFLAAISYV

SEQ ID NO: 27542 - protein, 417 aa, Xanthomonas campestris
MFSRDVRLETYDPELAKAIAAEAGRQEDHVELIASENYCSPLVMEAQGSQLTNKYAEGYPGKRYYGGCEFVDIAEQLAIDRIKQVFGADYANVQPHSGSQANQAVYLALLQPGDTILGMSLAHGGHLTHGAKVNASGKLFNAVQYGVNEQGLIDYDEVQRLATEHKPKMVIAGFSAYSQKIDWARFRAIADSVGAYLFVDMAHVAGLVAAGVYPSPMDHAHVVTSTTHKTLRGPRGGIILAKGAGEDLVKKLQSIVFPGIQGGPLMHVIAAKAVAFKEALEPEFKTYQQQVVKNAQAMANTLIARGYKIVSGGTENHLMLVDMIGRDVSGKDAEAALGKAHITVNKNSVPNDPRSPFVTSGLRLGTPAITTRGYQEQDCVDLANWIADVLDAPADDAVLAKVRDAVTAQCKKYPVYG

SEQ ID NO: 27543 - protein, 225 aa, Zea mays
MLQCLDGVKQLLGVLLKCCHIDLKQPNGLEDPEVLARETVFSVSEVEALYELFKKISSAVIDDGLINKEEFQLALFKTNKKESLFADRVFDLFDTKHNGILGCEEFARALSVFHPNAPLDEKIEFSFQLYDLKQQGFIERQEVQQMVVATLAESGMNLLDEVIESIIDKTFEEADTKHDGKIDKEEWRNLVVRHPSLLKNMTLQYLKDITTTFPSFVFHSQVDDT

SEQ ID NO: 27544 - protein, 319 aa, Fusobacterium nucleatum
MEYFKKFKERKIMEKIYDVIIVGAGPAGLTAGIYAGRGNLSTLILEKEGIGSMIMTHQIDNYPGSHIGASGKEIYDTMKKQALDFGCEIKPATVLGFDPYDEIKVVKTDAGNFKTKYIIIATGLGKIGAKKVKGENKFLGAGVSYCATCDGAFTKGRVVSLVGKGDEIIEEALFLTRYAKEVNIFLTSDDLDCNEELKEAILSKENVKITKKVKLLEIKGEEFVTELELEIAGNKETISTDFVFLYLGTKNNIELYGEFVNLSEAGYIITDETMKTRTDKMYAIGDIREKDVRQVATATNDGVIATTFILKEILKSKKK

SEQ ID NO: 27545 - protein, 343 aa, Unknown
  Mycobacterium sp. MCS
MSSDRERRSPHRRRRPTMAHVLPVLDLTDADTDPAGFRARLREAAHDAGFFYLVGHGVPVERFERVLRLARDFFTQPPERKNEISQLLSPQFRGYSRLGGELTNGTVDWREQIDIGPERDVIEGAEGYWRLQGPNLWPAQPPGFRAAFEEWGAALSEVGVRLLRHWAVSLGAAEDTFDAAFADRPATLMKVVRYPGTTQTAQGVGAHKDSGVLTLLLVEPGSVGLQVESGPDEWIDVPPLPGAFIVNIGELLEVATGGYLRATRHRVLAPPPGTDRISIPFFLNPALDALIPILPLPPELAVRSRGVETDPDNPIFNTYGENAWKSRTRAHPDVAELHHGITR

SEQ ID NO: 27546 - protein, 406 aa, Unknown
  Acidovorax sp. JS42
MHTQAPASLPRRRLLAGSASALAAAGLASFHQGAAAQSAAPAAAKPLPGYAGWKNADAVIVHSSTTIETRRGAFGTSVITPSDQLYVRNNLPTPPESIVADRDAWQVQVSGVKEPRRLSVRELKAMGLETVTMVLQCSGNGRGFFPSKPSGTPWTVGAAGCVVWSGVPVRDVARALGGVADGMKYMTGTGGEVLPAGIDPKTVIVERSVPLEAMQDALLAWEMNGEPIPLAHGGPLRLIVPGYTGVNNIKYIGQLAFTDKESEARIMSHGYRISPPGGKGDPSQPSVQQMSVKSWINGPLPEDGELAPGRVQIHGVAFGGMHAVKGVEVSVDGGKTWQAARLVGPDMGRYAWRQFVLQADLPRGSHTLASRATDAQGNVQPEQREENQAGYNNSSWADHAVTVKVA

SEQ ID NO: 27547 - protein, 539 aa, Streptococcus pyogenes
MKFTEFNLSQDIQSAVVTAGFEKASPIQEMTIPLALEGKDVIGQAQTGTGKTAAFGLPTLNKIRTNENIIQALVIAPTRELAVQSQEELFRFGREKGVKVRSVYGGSSIEKQIKALKSGAHIVVGTPGRLLDLIKRKALILDHVETLILDEADEMLNMGFLEDIEAIISRVPADRQTLLFSATMPAPIKQIGVKFMKDPEHVQIKNKELTNVNVDQYYVRVKEQEKFDTMTRLMDVNQPELSIVFGRTKRRVDEITRGLKLRGFRAEGIHGDLDQNKRLRVIRDFKNDQIDILVATDVAARGLDISGVTHVYNYDITQDPESYVHRIGRTGRAGKSGESITFVSPNEMGYLSMIENLTKKQMKPLRPATAEEAFQAKKKVALKKIERDFADETIRSNFDKFKGDAVQLAAEFTPEELALYILSLTVQDPDSLPEVEIAREKPLPFKYVGGGHGNKNGKGGRGRDNRNRGDRRGGYRGDRNRDERDSDRRRQKRDKRDGHDGSGNRDFKRKSKRNSKDFFNKEKKSSAKNTGFVIRHKGE

SEQ ID NO: 27548 - protein, 548 aa, Oryza sativa
MAAAAARSGAHPPSFASSLGRCRVLPVVVVRRPGGAARPSPLLAPARCAAAVGTAAPKVEGGGRRSSEQGQLAVAPARLVDELVEEALVWSSQHGLVVGDKNHPVKCCPILIDSTGNSQLNHTDFLSGARFGWGDQIVGLKVANMHRSGKAPGVGLLHAPFALLPMSFSKVYWDQAVELAPLFNELVDRVSLDGDFLQETLASFSLSFSRTKEVDSFTGRLLDIHAKMMKLNKKEDVRLGLTRSDYMVDGATDQLLQVELNTISTSSNGLACGVCELHRNLIRQHERELGLDPESVVGNTAIAQHAEALAGAWAEFNNQRFSVVLVVVQPEERDGLPVAVVYFRAGYTPNDYPSEAEWRARLLIECSSAIKCPSIAHHLVGTKKIQQELAKENVLERFLDNKADIEKVRKCFAGLWSLENDSIVMSAIESPELFVLKPQREGGGNNIYGDNLRETLISLKKDGSNELAAYILMQRIFPPASLCYLVRDGTCIRENAVSEFGIFGAYLRNKDRVIINDQCGYLMRTKAASLNEGGVVAGYAFLNSVFLT

SEQ ID NO: 27549 - protein, 481 aa, Exiguobacterium sibiricum
MSKKPFTDFQLSTPILEAIEQLGYHTPTDVQQAVIPVALSEKDIIVKSRTGSGKTASFGIPLCELVEWEENKPQALILTPTRELALQVTEDVMNIGRYKRIKATAVFGKQPFRGQVAELKQKTHIVVGTPGRVLDHLERGTLSLEKVKYLVLDEADEMLNMGFLDQVDTILKQLPKQRTTMLFSATFPQDIHQLSDRYMQSPKQVEITTKATEIAEIEHSYIKVTDKTKFAVLKDVTVVENPDRCMIFCRTKEHVDFVAQGLASMDYPVEKIHGGMEQDERLAVMKAFRAGEFRYLVATDVAARGIDIENITHVIQYDMPVEKESYVHRTGRTGRAGALGKAISLVTESDMRRLREVEQYRGEAIERRQAPTERELIRTADAFEEKITTADVRASKTEQLNADIMKLYFNGGKKKKLRAVDFVGTIAKIEGMTAQDIGIITIQDTVTYVEILNGKGPLVLRAMKTTKVKGKQLKVYEAFKK

SEQ ID NO: 27550 - protein, 112 aa, Unknown
  Nostoc sp. PCC 7120
MKKVEAIIRPFKLDEVKIALVNAGIVGMTVSEVRGFGRQKGQTERYRGSEYTVEFLQKLKVEIVVEDNQVDMVVDKIIAAARTGEIGDGKIFISPVEQVIRIRTGEKNTEAV

SEQ ID NO: 27551 - protein, 366 aa, Arabidopsis thaliana
MALSAIGFEGYEKRLEVTFFEPSIFQDSKGLGLRALTKSQLDEILTPAACTIVSSLSNDQLDSYVLSESSFFVYPYKVIIKTCGTTKLLLSIPPLLKLAGELSLSVKSVKYTRGSFLCPGGQLFPHRSFSEEVSVLDGHFTQLGLNSVAYLMGNDDETKKWHVYAASAQDSSNCNNNVYTLEMCMTGLDREKAAVFYKDEADKTGSMTDNSGIRKILPKSEICDFEFEPCGYSMNSIEGDAISTIHVTPEDGFSYASFEAVGYDFNTLDLSQLVTRVLSCFEPKQFSVAVHSSVGANSYKPEITVDLEDYGCRERTFESLGEESGTVMYQTFEKLGKYCGSPRSTLKCEWSSNNSCSSEDEKDEGI

SEQ ID NO: 27552 - protein, 404 aa, Mycobacterium smegmatis
MRELPHVLGIVLAGGEGKRLYPLTADRAKPAVPFGGAYRLIDFVLSNLVNARYLRICVLTQYKSHSLDRHISQNWRLSGLAGEYITPVPAQQRLGPRWYTGSADAIYQSLNLIYDEDPDYIIIFGADHVYRMDPEQMMQFHIESGAGATVAGIRVPRSEASAFGCIDADESGRIREFIEKPADPPGTPDDPEQTFVSMGNYIFTTKVLIDAIRADADDDHSDHDMGGDIIPRLVADGMAAVYDFKNNEVPGATERDHGYWRDVGTLDAFYDAHMDLVSVHPVFNLYNKRWPIRGESENLAPAKFVNGGSAQESVVGAGSIISAASVRNSVLSSNVVVDDGAIVEGSVLMPGVRIGRGAVVRHAILDKNVVVGPGEMVGVDLDKDRERFAISAGGVVAVGKGVWI

SEQ ID NO: 27553 - protein, 197 aa, Alkalilimnicola ehrlichei
MMNRSAEVQRDTLETRVKVRLDLDGTGESRIRIGVPFMEHMLDQVARHGLIDLDIEADGDTHIDDHHTVEDVGITLGQALAQALGDKKGIRRYGHAYVPLDEALSRVVVDFSGRPGLQFHVDFVRARIGQFDVDLFQEFFQGLVNHAALTLHVDNLRGINAHHQAETVFKALGRALRMAAEADPRQADRIPSTKGAL

SEQ ID NO: 27554 - protein, 145 aa, Unknown
  Nostoc sp. PCC 7120
MRLLHTMLRVGNLEESLKFYCDVLGMKLLRKKDYPGGEFTLAFIGYGDESDNTVIELTYNWGVEKYELGNAYGHIALGVDDIYATCESIKTQGGKVVREPGPMKHGSTVIAFVEDPDGYKIELIQLSNQGATVKQDSSEQLVKQG

SEQ ID NO: 27555 - protein, 326 aa, Solanum tuberosum
LLLVGLLIQITGAQPIGVCYGKIANNLPSDQDVIKLYNANNIKKLRIYYPDTNVFNALKGSNIEIILDVPNQDLEALANPSNANGWVQDNIRNHFPDVKFKYIAVGNEVDPGRASGKYARFVGPAMENIYNALSSAGLQNQIKVSTATYLGLLTNTYPPKDSIFREEYKSFINPIIGFLARHNLPLLANIYPYFAHADDNVPLSYALFKQQGLNDAGYQNLFDALVDSMYFATEKLGGQNIEIIVSESGWPSEGHPSATLENARTYYTNLINHVKGGAGTPKKPGKTIETYLFTMFDENRKDGKPSEQHFGLFYPDKRPKYQLNFN

SEQ ID NO: 27556 - protein, 453 aa, Ammopiptanthus mongolicus
SDCYDSNVTASSQNKTSGQRCECPFGYSGDPYIAGSCTAIPRFYGETIRSKKWALVGVLSSLGSIILLFGLWWLYKVVRKRMIKKRKEKFFKQHGGLLLQQRLSSGEVSVDRAILFSLKDLERATDNFNINRVLGKGGQGTVYKGMLVDGRTVAVKKFKVQGKVEEFINEFVILSQINHRNVVKLLGCCLETEIPLLVYEFIPNGNLFQYLHDQNEDLPMTWDMRLRIATEIAGALFYLHSVASQPIYHRDIKSTNILLDEKYRAKVADFGTSRIVSIEATHLTTVVQGTFGYLDPEYFHTSQFTEKSDVYSFGVVLAELLTGRKPISLVSSEEAKNLASYFALSMEEDSLFEIIDKRVAKKGEKEHIMGVANLAYRCLELNGKKRPTMKEVTLELERIRGPDKKFNAQQNHEEIELARIEDYQPYSTSNTFPTLSRGSPSSEVMPVLTSDNW

SEQ ID NO: 27557 - protein, 146 aa, Phaseolus vulgaris
MGAFTEKQEALVNSSWEAFKGNIPQYSVVFYTSILEKAPAAKNLFSFLANGVDPTNPKLTAHAESLFGLVRDSAAQLRANGAVVADAALGSIHSQKGVNDSQFLVVKEALLKTLKEAVGDKWTDELSTALELAYDELAAAIKKAYA

SEQ ID NO: 27558 - protein, 568 aa, Zymomonas mobilis
MSYTVGTYLAERLVQIGLKHHFAVAGDYNLVLLDNLLLNKNMEQVYCCNELNCGFSAEGYARAKGAAAAVVTYSVGALSAFDAIGGAYAENLPVILISGAPNNNDHAAGHVLHHALGKTDYHYQLEMAKNITAAAEAIYTPEEAPAKIDHVIKTALREKKPVYLEIACNIASMPCAAPGPASALFNDEASDEASLNAAVEETLKFIANRDKVAVLVGSKLRAAGAEEAAVKFADALGGAVATMAAAKSFFPEENPHYIGTSWGEVSYPGVEKTMKEADAVIALAPVFNDYSTTGWTDIPDPKKLVLAEPRSVVVNGVRFPSVHLKDYLTRLAQKVSKKTGALDFFKSLNAGELKKAAPADPSAPLVNAEIARQVEALLTPNTTVIAETGDSWFNAQRMKLPNGARVEYEMQWGHIGWSVPAAFGYAVGAPERRNILMVGDGSFQLTAQEVAQMVRLKLPVIIFLINNYGYTIEVMIHDGPYNNIKNWDYAGLMEVFNGNGGYDSGAGKGLKAKTGGELAEAIKVALANTDGPTLIECFIGREDCTEELVKWGKRVAAANSRKPVNKLL

SEQ ID NO: 27559 - protein, 1442 aa, Mougeotia scalaris
MDRTIDISDEKWQSRFAAQSSQAAESQYSSDALLNEEYENASIHGSFVSYKELMKSSAEAPKPWEVDQIAYLEKMRRSGLTQRFGTMLVVEPPLRHAQKLHLLAHSENAVDLPGIEPRELEIGGDILPFFTSESGKALFSEAASKGDSVKTAIVTGRDGETKFYAICHRNACGVIIDLEPVVPKGIHTSYEPNLDTSSPPLSMEAALDIVQPAIQRLKAIPAGSVQEICDTVTREVRELLQYDRVIVYKFHPDQHGEVFAESAKEGLDPYVGLHYPSTDLPQAIRVLLLRVGIRMICDATQSMVKIVQPDDVEPVDLSDSTLRAPHGCHAQYMINMGSLSSITFAIVVESDKTVRAGEEPEKERTLWGIIVGHHSIPRFTPYPLRKAVQSLAETFGSLLTREIALAASWHEEKTLNMQKKLCDMLEADIPLGIVIDSPNIQDLVKCDGAALFFSGRFWLLGSTPTERQVADLAEWILKHLSKKGAVCTDSLAEAGYPNADELGSKTCGMVAVKVGKRDFVFWFREHTAKVVRWAGQRQKKEEIDDESKMMPRNSFKAFMEIVRERCLPWEDIELEAINGLRLMLQDALDVSRGADIPVVVGGTTIEGDPFDGAGYHESTSEKPVSAITSEVEAALSAVEACFLITDATQESRPIIYCSHVFSTLTGYSAGELEGGTLEKLEGLETDVAAASKLHLALSGRTQYSGRLLHYKKDGTPFWNLITCGPIKNGQNEVVNFVIVFQELAKYHEISSVPPNLVDGDLSAPEKGFPVSLIRYDGRLKEKSSRIVDEIIRLVKNPATIADSLALLGQMSAMASPAVSQVESVPVVEHRERHSSMHIAKPAATKTSRRRSLVEVLLGKGREIEAPVKEAFDSDVKSDDGKKRRAAKGIDLGTTLERLDYGFLVIDTRLDECPIIFMSDRYILQTQHTREENIGGDILFLDGEESSPAEVDKIRKAVQNNDELSLQLVAYRKNGDKFWALYHLSVAKDKDGNALYIINVVKDLGEAQISDAAFRKEDAEARKEAAEITRALHDLPDTAAYELWTVHSKFVASKPHRAWDSAWTAIKEVREKEGRLCLKHFKPIKPLGNGDSGSVVLVELRGTGHVFAAKIMEKERMIERNKVHRIASEREILNQLDHPFLPSLYASFQTTKHVCFITNFCPGGELYDFLEIQPYHRFEEHVAQFYAAEILTSLEYLHCQGVVYRDLNPENILLAEDGHIVLTDFDLSILSSTFPKLIREANGTSKRKSSRRPSKERAPTFVAEPTMRSNSFVGTEEYISPEIVTGEGHGPSIDWWSFGILIYEMLYGETPFCGSSMNKTFHNILNKEVAFPSPVPVSDMAKDLITSLLIKDSEKRLGSKLGAAEIKVHPFFHGINWPLIRNKKVVPPKVPNKLNSVVGGHEEQDISSNHWRLQDTNNDSNRSFPIMSFDGSIIDATEDRSTW

SEQ ID NO: 27560 - protein, 323 aa, Mycoplasma genitalium
MDKIAILTSGGDASGMNATIAYLTKYAIAKQLEVFYVKNGYYGLYHNHFITSKELDLTDFFFMGGTVIGSSRFKQFQDPSLRKQAVLNLKKRGINNLVVIGGDGSYMGAKALSELGLNCFCLPGTIDNDVNSSEFTIGFWTALEAIRVNVEAIYHTTKSHNRLAIIEVMGRDCSDLTIFGGLATNASFVVTSKNSLDLNGFEKAVRKVLQFQNYCVVLVSENIYGKNGLPSLEMVKEHFENNAIKCNLVSLGHTQRGFSPNSIELFQISLMAKHTIDLVVNNANSQVIGMKNNQAVNYDFNTAFNLPKADRTKLLNQVNTAII

SEQ ID NO: 27561 - protein, 413 aa, Vibrio fischeri
MGQAAKAAAFDLAVAPTAQKNKALAIIADELEANKDAILAANEKDIKAAVEAGISEAMQDRLLLTEERLVGIANDVRNVINLNDPVGSEIDSKVLENGMSLSRRRVPIGVIGVIYEARPNVTIDIASLCLKTGNASILRGGKETFFSNMELVKVIQVALEKAGLPAASVQYIEKPDRELVSQLLTMDDYVDMIIPRGGAGLHKMCKENSSIPVIIGGFGISHAFVDESADLERALVVVDNSKAQRPSACNALDTLLVHEAVAPQFLALLANNMAGRVELVAEPKAYGLLKEFEGVSLREAQEGDFDTEWLSYTLGVKVVADVNEAAAHMQKHNASHSDTILTNNIESAEKFINTAGSAAVYVNASTRFTDGAQFGLGAEVAVSTQKLHARGPMGLEELTSYKWVGKADYLIRS

SEQ ID NO: 27562 - protein, 925 aa, Pseudoalteromonas tunicata
MTKLGLRDWILVLASVPTLLIGLLLGGYFTLNRYLDLNDFLLDQGITIIEPLAIATEQPLAERNKKLLNRLVSQSHNKHAPLIKSIAIFDANKELLITSNYHKDFHLLTPFNVVPNQGLTSKETDNHLVLSLPILDHNNLDNGLLLTAEQTLLGYIVLELNQNQALVGQQKALLVSGFIILLAFFISILMALRFSKLFLTPMSKLLFAIDKLKEGDQDTSINEPMRGEFELLRQGLNSIAHNMMLQKDEMQKHIDQAISDYRETLEQYETQNIQLNIAKKEAQDANRVKSDFLAKMSHELRTPLNGVVGFTRQLYKTPLNKHQKDYLDTIELSANSLLAIINDILDFSKLEAGAMELESIHFQLRDTVNEVLTLLAPSAHDKNLELSINIHDNVPDSLIGDPTRFKQILINLISNAIKFTESGHVLIDVDCRHYANQRTSIFVAINDSGIGISANKQDALFSAFGQADSSITRKFGGTGLGLIITKHLVEAMGGHISLNSAVGKGSCFTFNAFFEQPKRHYSDNLPTTPLEQKRVLYFETHHHTHEATQSLLQSWNMHVTACLSLAELEQALTGEFSFDIAILGHAASLDNMSEIKSLVNRVRPQCDYLYLMVNTVSHNMREAFIGTGADACLSKPLNHRKLCESLAAPYRLDHPSIQTPEQAQRILPIKVLVVDDNDANLKLMCTLLAEQIEFIDTAHNGSQALSLAKTHKYDLIFLDIQMPIMDGVTACKLIIESSINESTPIIAVTAHALAGEKENLLKVGFKNYLTKPLDEEVLRQTIFEYSPDFGKSKTLIAQPIESKPVVAPFDSKRIDWPLALQRAGGKVELAHEMLNMLLLSVPETLAELRDATELEDKQRVLNIVHKFHGACCYTGVPKLKQLAETIETALKQDQSLSQIEPELFELDDELVNLMIDAQAQIATPA

SEQ ID NO: 27563 - protein, 368 aa, Brassica napus
MALSAIGFEGYEKRLEVSFFEPSFFQDSKGLGLRALTRSQLDEILTPAACEIVSSLSNDHLDSYVLSESSFFVYPYKVIIKTCGTTKLLLSIPPLLKLAGELYLNVKSVKYTRGSFLCPGGQPFPHRSFSEEVSVLDGHFTKLGLNSVAYLMGNDDETKKWHVYAASAQTSSDCNSNVYTLEMCMTGLDKEKASVFYKNETGGENGSMTDNSGIRKILPQSQICDFEFEPCGYSMNSVEGDAISTIHVTPEDGFSYASFEAVGYDFTTMDLSHLVSRVLTCFEPKQFSVAVHSSVAQKSYDHSGLSVDLEDYGCRETTVESLGEERGTVMYQRFEKLGMYCGSPRSTLKCEWSSNSSCTSEDEKEEGI

SEQ ID NO: 27564 - protein, 659 aa, Bacillus pumilus
MLIFETYLILFKTVQITKRRIERRRLRLLNQCFTKKEGVSNREMASYNYVEVLQKSMLFYEAQRSGRLPESNRLNWRGDSGLKDGKDVGHDLTGGWYDAGDHVKFGLPMAYSAAVLAWTVYEYREAYEEAELLDEILDQIKWATDYFLKAHTGPNEFWAQVGDGNADHAWWGPAEVMPMNRPAFKIDEHCPGTEVAAQTAAALAAGSIIFKETDASYAAKLLTHAKQLYAFADRYRGKYTDCVTNAQPFYNSWSGYVDELIWGGIWLYLATNEETYLNKALKAVEEWPQDWDYTFTMSWDNTFFASQILLARITKENRFIESTERNLDYWTTGLVQNGKVERITYTPGGLAWLDQWGSLRYAANAAFLAFVYADWVSDQEKKNRYQSFAIKQTHYMLGDNPLNRSYVVGFGQNSPKHPHHRTAHGSWSNQLTNPPSHRHTLYGALVGGPNAQDQYDDDISDYISNEVATDYNAAFTGNIAKMVQLFGEGQSKLPNFPPKEQVEDEFFVEAAVMHNDTTSTQVKAVLYNRSGWPARSSQTLSFRYYVNLSEVFAKGFTEKDIQVTAAYNEGASLSPLKVYDASSRVYFAEIDFTGVVISPRGESEHKKEIQFRLSAPNGSNIWDASNDYSYQGLTSNMQKTTKIPVFEDGVLVFGTLPDK

SEQ ID NO: 27565 - protein, 113 aa, Cucumis melo
MEQDFHAERFDDFLREVAIMKCLRHPNIVLFMGAVTEPPNLSIVTEYLSRGSLHRLLYRPGAREVLDERRRLNMAYDVAKGMNYLHKRNPPIVHRDLKSPNLLVDKKYTVKVC

SEQ ID NO: 27566 - protein, 621 aa, Cucumis melo
MMFNEMGMCGDMDFLSASIVEGDAVAPPTDPEVVVEDDYSDEEIDMDELERRMWRDKMRLKRLKEQSKVKEGIDIVKQRQSQDQARRKKMSRAHDGILKYMLKIMEVCNAQGFVYGIIPEKGKPVTGASDNLREWWKDKVRFDRNGPAAIAKYQADNAIPGRNDGCNSIGPTPHTLQELQDTTLGSLLSALMQHCDPPQRRFPLEKGVPPPWWPSGAEEWWPQLGLPKDQGPPPYKKPHDLKKAWKVGVLTAVIKHMSPDIAKIRKLVRQSKCLQDKMTAKESATWLAIINQEEILARELYPDSCPPLSSGGGSGSLVINDCSEYDVEAVRSDDNHIDVQDRKPANHSSFNLGMDRMRDRVSLRQPPYAMKGEVTTNLDFMRKRKPTSDLNMMMDQKIYTCEFLQCPYSELRLGFNDRTSRDNHQLTCPYRTSSEFSGSSFHVNEVKPVIFPQSFAPPKSNAPPGQLSSVIFPTLFHLSPEDGQKLISELIYDTNIQGNKNNLNTGNSATTENQKSPSIKRSNLNKMIDFRDQGLMMEGNFFDGSNVSSSHQMFTRDEGQSDRFKPMNSPFENNHHHHNNNNNNFHLMFSSPFDLSTFDYKEEVPGVAAIDTLSKQQDVSM

SEQ ID NO: 27567 - protein, 673 aa, Glycine max
  misc_feature (359)..(359): Xaa can be any naturally occurring amino acid
TRPHSQRTIYNVYSFWYCSFFFLCCLYLIIVICEASFGPSYEYSKYCNNSNGNYTANSIYQTNLNTLLSTLTSHTEIDYGFYNFSHGQNSDKVYAIGLCRGDVKPDECRSCLNNSRVSLTRLCPKQLEAINWEEKCMLRYSNRAIFHTMDASFSYHMNNVNNATDAEEFNKVLGELLRNLSDKAASGDSRRKYAADTAVFANLQTIYGLVQCTPDLSRQDCGKCLHWSLADFGNVFKNKVGAVVLRPSCNVRYEIYPFYDEPTPSASVPLSLKEKGNSLRTTIAIVVPTVLVVVALLIFISIYFRRRKLARKNLLADEDDDEIELAESLQFNFDTIKVATNNFSDSNKLGEGGFGAVYXRLSNGQVIAVKRLSSDSGQGGVEFKNEVLLLAKLQHRNLVRLLGFSLEGKEKLLVYEYVPNKSLDYFIFDPTKKERLDWDRRYKIIQGIARGLLYLHEDSRLRIIHRDLKASNVLLDEEMIPKISDFGMARLIVAGQTQENTSRVVGTYGYMAPEYIMHGQFSIKSDVFSFGVLVLEIVSGQKNHGIRHGKNVEDLLNFAWRSWQEGTVTNIIDPILNNSSQNEMIRCTHIGLLCVQENLANRPTMANVALMLNSCSITLPVPTKPAFFMDSATTSLPNMSWEVNSGTTRSNQSTTKSAHDSVSETSISELYPR

SEQ ID NO: 27568 - protein, 772 aa, Xylella fastidiosa
MQNSLLTQHIAQIIATEISSQPTQARAAIALLDEGASVPFIARYRKEATGGLDDTQLRTLETRLTYLRELEERRSAILASITEQGKLNDLIHAEILAADTKSRLEDLYLPYKPKRRTRAQIAREAGLEPLADSLLTDPTLIPETVAANFVDPEKGITDIKTALEGARVILIERWGEDAALIGELRQWLANNGVIHARLIDNKEDTGAKYRDYFNHTELLSKIPSHRLLALFRARSEEILHLDLDPGNDADAGHQYCESMVMQAACVADQGRPADTWLMTACRLTWRAKLHMHLMLDLFNQAREKAEAEAITVFSNNLKDLLLAAPAGPRIVLGIDPGIRTGCKIAIVDTTGKLIATETIYPHEPRREWDKSLHTLKTLCTQHHVTLIAIGNGTASRETDKLVSDLIKAHPALKLQKIVVSESGASVYSASESAAKEFPNLDVSLRGAVSIARRLQDPLAELVKIDPKAIGVGQYQHDVDQFHLAKALDARVEDCVNAVGVYVNTASAALLSRVSGLSASVAENITRYRDEHGSFKQRQDLLKVPRLGAKTFEQCAGFLRIADSNQPLDASAVHPEAYPVVERIVQTTGKPIKALIGDSHTLRMLKPEQFTDTNFGIPTIRDIIKELEKPGRDPRPEFKAVRFTEGVENIKDLKPGMILEGVVSNVAAFGAFVDIGVHQDGLIHISALADRFVKDPRDIVKAGDIVKVKVLEIDLPRKRIALTCRLHEETPPETPAANRTGNERGRPNPVAKKLKATPTDNALAQAFARARLK

SEQ ID NO: 27569 - protein, 612 aa, Medicago truncatula
MTTIRKNSNEPINNHVGLNGFQNHVTNDSMNNKPNCSIQNKALLVKNESDTLGHHIAKRLVEIGINDVFAVPGDFNLTLLDYLVAEPEINLIGCCNELNAGYATDGYARCRGVGACVVTFNVGGLSILNAIAGSYSEDLPIICIVGAPNSNDFGSNKILHHTIGLPDFSQELRCFEPVTCHQAVIKDIDDAHEKIDTAIAIALRESKPVYISIACNLPTIPHSSFTDQSIPFYLTPKVTNQMSLEIAVEATTKLLNKATKPVMVGGPMMRISKASEAFMEVADASGYAIAVLPSAKGMVSENHPHFIGTYWGVASTSFCAEIVESADAYLFAGPLFNDVITMGHSLLIKKEKAITVLPNRVVIGNGPTFGNISMKEFFKALTKRLERNATAIENYKRIFIPDGFPVQCNPKEALRINVLFRHIEKMLSCDSAVIAECGDAWFNSQKLKLPQGCGYECQLQYASLGWSIGATLGYAKSNPQKRVIACIGDGCFQVAGQEVSTMLRWGQNVIIFLINNGGYTTEAEIHDGPYNVIKNWNYAGLIETIDNGEGKCFTAKVHCEEELIEAINTTMESKKNCLCFIEVVMHKDDTSKELLQLGNRLAALNGRLPQHN

SEQ ID NO: 27570 - protein, 403 aa, Fusobacterium nucleatum
MYCCTKINDDIIWIGINDRKTERFENYIPLDNGVTYNSYLIMDEKICIVDGVEEGENGNFLSKIEAMIGNSPVDYIIVNHVEPDHSGSIKNMLKIYPELKVVGNAKTIMMLKLLGLDLPDERVVIVKEKDILDLGKHKLTFYLMPMVHWPESMATYDITDKVLFSNDAFGSFGALDGAIFDDEVNTDFFTDEMRRYYSNIVGKFGAPVNAILKKLSSVEISCICPSHGLIWRKYIKEIIERYQKWANMEPTKEGVVIVYGSMYGNTAEMAEILGRELGNRGIKDVIIYDSSKTDHSYIFSTIWKYKGLMLGSCAHNNDIYPKMEPLLHKLENYGLKNRYLGIFGNMMWSGGGVKRIKEFANTLTGLEQVGEPIEIKGHVTSAERDRLIELANLMADKLIANRK

SEQ ID NO: 27571 - protein, 753 aa, Methanosarcina acetivorans
MTEEMNLRVAEAYHKDVGRGIARIDTRLMQEMGLVSGDIIEISGRSKTYAIVWPNVERGQENRIRIDGNLRSNAKVGIDDRVTIQKVQAKHAQRVTLAPSQPVRLVGGAHYILRIIEGRPLNKGQQIRVETVNNPLTFVVASTRPAGPVVVTKDTEIVIKEKSIEEIKTPEGISYEDIGGLRREIQLVREMIELPMRHPELFQKLGIEPPKGVLLHGPPGTGKTMIAKAVASETDANFITISGPEIVSKYYGESEQKLREIFDEAEKDAPSIIFIDEIDSIAPKRGEVTGEMERRVVAQLLSLMDGLKSRGEVVVIAATNRPNSIDEALRRGGRFDREIEIGIPDRNGRRQILLIHTRGMPLEDEVSLGEIADVTHGFVGADLSSLCKEAAMHALRRITPEIDIEEEIPQEIIDNLVVTKEDFREALKNIEPSAMREVYVEVPHVGWDDIGGLDKAKQELIESVEWPLKYPEMFKAVNIKPPRGVLLFGPPGTGKTLLAKAVASESEANFISIKGPELLSKYVGESERAIRETFRKAKQAAPTVIFFDEIDSIAPERSSVSDTHVSERVVSQILTELDGVEELKDVIIVAATNRPDMVDPALLRPGRFDRLIYIKPPGKEGREKIFEIHTKGKPLAEDVKLSELAEMTEGYVGADIEGICREAAMLALREIVTPGTDRKSIKEKAGDVRLSKRHFERAIRRVRPTTSRETLSAYEKSAELFARYAAELEEESSEAKEEEKEIEGKEVPNFPKV

SEQ ID NO: 27572 - protein, 77 aa, Zea mays
  misc_feature (21)..(21): Xaa can be any naturally occurring amino acid
GIPGSTHAFGGAKSGCIWYYXPENHWWISEGIKKRPESSGTNPALHSNHLYLATTSTDCKFQMVSTFIKGVNPKGSP

SEQ ID NO: 27573 - protein, 474 aa, Gluconobacter oxydans
MMRTLFLQPPSFDGFDGGAGSRYQAKREIKSFWYPTWLAQPAALVPGSRLIDAPPAKMGMDPILEDVKNRDLVVMHTSTPSFASDVRVAQMLKDANPKLMIGMVGAKVAVQPMESMEKGGPIDFVARNEFDFTIKEIAEGKPLAEVDGITWRNEKGEIIANKDRAMIEDMDSLPFVTEVYKRDLNINDYFIGYLKHPYISIYTGRGCKSRCTFCLWPQTVGGHRYRTRSPEHVAAEVRLAKQYFPEVQEFMFDDDTFTDDLPRAEAIAREMGKLGVTWSCNAKANVPYETLKVLKENGLRLLLVGYESGNQQILHNIKKGMRVETAKEFTRNCHKLGIKIHGTFIVGLPGETKETIQETIEFAKEINPHTLQVSLAAPYPGTFLHKQATENGWLNEAEAELIDESGVQIAPLHYPHLSHTEIFESVEEFYRKFYFRGSKIASIVNEMVRSPQMMKRRLREGVEFFQFLKDRHAA

SEQ ID NO: 27574 - protein, 413 aa, Listeria innocua
MVYLQKQDKEVFDAIKLELGRQRANIELIASENFVSEQVMEAMGSVLTNKYAEGYPGKRYYGGCEFVDIVEDLARDRAKKLFGAEYANVQPHSGAQANMAVYHTVLEPGDTVLGMNLSHGGHLTHGSPVNFSGVLYNFVEYGVREDTKEIDYEIVREAALKHKPKMIVAGASAYPRKIDFAKFREIADEVGAYLMVDMAHIAGLVAAGLHQNPVPYADFTTTTTHKTLRGPRGGMILAKAEWEQKLNKSIFPGIQGGPLMHVIAAKAVAFGEALQPEFTAYCEQIIRNSKKLAETLQANDVAVLTGGSDNHLLLIDLKPLGLTGKAAEKVLDEVGITVNKNTIPFETESPFVTSGIRVGVAAVTTRGFDEVAIEKVGVLISEVLHNLENEEVLADVKARVANLTNEYPLYPSL

SEQ ID NO: 27575 - protein, 184 aa, Brassica rapa
MEHSEESQPQQGVMDYVPPRAYQSGMPSSMAFHHQQLQLFWATQMQEIEQTTDFKNHNLPLARIKKIMKADEDVRMISAEAPVIFAKACEMFILELTLRSWIHTEENKRRTLQKNDIAAAISRTDVFDFLVDIIPKDDLKEEGLGVTKLTMPTVVDSPPYYYLQQQQQQGVWAQGNLEQHHDDQ

SEQ ID NO: 27576 - protein, 125 aa, Oryza sativa
MRQARPYSAMFAGGVSARTGPHALPLARIKKIMKRSAGDSSVVDGGGGGGGGARMISGEAPVVFSKACELFIAELTRRAWAATLEGKRRTVHKEDVAAAVQNTDLFDFLVDVVTADLGDDHTDYK

SEQ ID NO: 27577 - protein, 349 aa, Magnaporthe grisea
MAKTEKAFTNAEKILMAKAWIYGIRPFFKHGKNFNPTRDIPPQTGKTMLVTGGASGIGAAFVAEIARHSPAQVWIADLRPEAAEKAISAISAECPDVKIDFLQIDLGDAESVKRAASEFLSRTERLDVLLNNAGILPAKGWTTKDGYESMFGVNFVGHARLTELLLPRLMETAAIPGADVRVVSVASGGHGVHPKPDGVRLSSGGALLKEPTCGGMTAMQRYAQSKLAVILWVRRLAREFPAITIVSAHPGTVATSIANDLSGSTRQPPAFFVKLTGTKTPEMGCYNQLWCATAPRDQLVSGKYYCPVGLPDQEFGIARDRKKADELEERLWVWLQKELKGDSFVKVDA

SEQ ID NO: 27578 - protein, 157 aa, Oceanobacillus iheyensis
MSIYEYQVEKSNGEEISLSQYQDNVLLIVNTATKCGFANQFEGLEELHQKYQDEGLRVLGFPSNQFNEQEPVDDENMEEACKVNFGVTFPLFKKIDVKGPNAAPLFKYLTEEQKGLLGSNVKWNFTKFLVDRNGNVVKRFAPKDKPAKIEDDIKALL

SEQ ID NO: 27579 - protein, 166 aa, Glycine max
  misc_feature (101)..(101): Xaa can be any naturally occurring amino acid
MAEQSSNSIYDFTVKDISGNDVSLNDYSGKVLLIVNVASQCGLTQTNYKELNVLYEKYKNQGFEILAFPCNQGAGQEPGNNEEIQEVVCTRFKAEFPIFDXVEVNGKNAAPLYKFLKEQKGGIFGDGIKWNFTKFLVYKEGKVVDRYAPTTSPLKIEKDIEKLLQS

SEQ ID NO: 27580 - protein, 922 aa, Unknown
  Sulfitobacter sp. EE-36
MADKVKFTLDGEEVEADTGLTIWEIANGRGLKIPHLCFTPEPGYRPDGNCRACMVEIEGERVLAASCLREPSDGMVVTTNNARAENARKMVMELLVTDQPAPEVAHDKSSHLWDMAAMEGISESRFPKLEEGRIPLLDDSHVAMRVNLDACIQCNLCVRACREVQVNDVIGMAGRGHDSYPVFDMADPMGASSCVACGECVQACPTGALMPATVVDDAQVGDSADFDSEVDSICPFCGVGCQVSLKVKDGKIKYVEGINGPANEGRLCVKGRFGFDYIHHPHRLTKPLIRRKDAPPKGLNVDPGNWQTHFREATWDEALDFAAGGMKKIGGAGVAGFGSAKCTNEEAYLFQKIIRQGFGHNNVDHCTRLCHASSVAALMENVGSGAVTATFNQIENADVAIVIGANPTENHPVAATFFKQFAKRGGKLIVMDPRGQALKRHASHMLQFRPGTDVSMLNAIMHVIVEEKLYDQQYIEAYTENWEIEKAHLKTFTPEKMSKICGIDAEVLRDVARTFAGANAAMIFWGMGISQHIHGTDNSRCLISLALMTGQIGRPGAGLHPLRGQNNVQGASDAGLIPMFLPDYQPVSDDGVRSAFTDVWQSSDFSDKKGLTVTEIMDAVHDGDIRSLYVLGENPAMSDPDVEHARDALAKLDHLVVQDIFLTETANFADVILPASAFAEKSGTVTNTNRQVQMGRPAVPPPGDAKEDWWIEVELAKRLGLGWTYTDPSEVFAEMKLNMSSLNNITWDRLESEGAVTYPSTSPTDPGQAIVFADGFPRQDGRARFTPASIIAPDDAPDEDYPMILTTGRQLEHWHTGSMTRRSYVLDGLEPEANCSLHPSTLRKLGVEPGAYIRLTTKRGSIELMAREDRAVSPDMVFLPFAYVEAAANILTNPAVDPYGKIPEFKFSAVKVEAATGPQPAE

SEQ ID NO: 27581 - protein, 414 aa, Geobacillus kaustophilus
MSELLEKAERLKTASQTLAMLSAEEKNEALEQIAQTLDRERAFILQENEKDMAQGREQGLSPALLDRLQLTNERLDQIIDGVRQVASLPDPVGEIIAEWTRPNGLRIQTVRVPLGVIGMVYEARPNVTVDAASLCLKTGNAVLLRGSTSALHSNKALVAVMKEALRTTAIPETAIELLEDTSRETAQRMFRLNNYLDVLIPRGGAGLIRSVVENATVPVLETGVGNCHIFVDESAERQMAIEIVLNAKLQRPSVCNAVETVLIHERWPYAADLLETLHARGVELRGDQRLASAYPFISEATEDDWYTEYLAPILAVKLVADVDEAIGHIRRYGTKHSEAIITENEVNVRRFFQAVDAAVLYHNASTRFTDGEQFGYGAEIGISTQKLHARGPMGLVAITTTKSLVYGTGQIRTV

SEQ ID NO: 27582 - protein, 216 aa, Brassica napus
  misc_feature (156)..(156): Xaa can be any naturally occurring amino acid
RPTRPSVSDSPGTSVAVSSILIGLLMLGRAAFVFPLSFLSNLAKKNQSEKIDFKMQVVIWWSGLMRGAVSMALAYNKFTRAGKTDLRGNAIMITSTITVCLFSTVVFGMLTKPLIRFLLPHQKATTSFLSDGNTPKSIQIPLIDQDSFIEFAGNHXNVPRPDSIRGFLTRPTRTVHYYWRQFDDSFMRPVFGGRGFVPFVPGSPTEREPPTDLSRA

SEQ ID NO: 27583 - protein, 667 aa, Legionella pneumophila
MGLYMEKMLINAMQTEEIRVALIKNNQLFDLDIECPGEIKKKGNIYKAIVTRREPSLDAVFVEYGSKRQGFLPLKEIAPEYLSKNPEEFGDEKPPITSLIREGQELLIQVDKEERGNKGAALTTFITLAGCYLVLMPNNPHSGGISRRIEGDERDELRETLNALTLPEDMGLIIRTAGVGKSLEELQDDLNMLCNQWQSIKEAYNSELAPCLIHQEGDVIIRSIRDNLRKSISEIIIDDQISYIKAKQYIERVKPEFLPNLKLYNSSIPLFNFYQIESQIETAYQRQVMLPSGGALVIDRTEALVSIDINSAKATGGADIEATALNTNLEAADEIARQLRLRDLGGLVVIDFIDMSSSKNQREVENRLKEALQADRARIQVGRISRFGLLEMSRQRLRLSLGETAQEICPRCEGRGTVRSIQSHGLSITRLIEEEALKEKTAEIQVQLPPEMATFIMNEKRNFIRDIEKRHGVSVVVIANPYMHPPQYTITRLKEDNVGKSKKPSYSLIQQPEVHVPSSDKEPVSHDEPAVKSFAEHRVIKHPQTSFIKRLWTSLFGGHSVAHTVTQEPGKKHHRAQNQGKHASSKSSGGDKRQQGSNANRRRRSGGGQQRSSSGNTNAAASTHQQRKKSNANQQSHGSQQSNRSIPAKNEGNKKREAILAKEPEEK

SEQ ID NO: 27584 - protein, 224 aa, Elaeis guineensis
MGRRPARCYRQIKNKPYPKSRYCRGVPDPKIRIYDVGMKKKGVDEFPFCVHLVSWEKENVSSEALEAARIACNKYMAKYAGKDAFHLRVRVHPFHVLRINKMLSCAGADRLQTGMRGAFGKPQGTCARVMIGQVLLSVRCKDGNSNHAQEALRRAKFKFPGRQKIIISRKWGFTKFNRTDYLRWKSENRIVPDGVNAKLLGCHGRLSARQPGRAFLPPTIANAS

SEQ ID NO: 27585 - protein, 219 aa, Malva pusilla
MADEVVLLDFWPSPFAMRAKLALELKGINYECKQQDLLNKDPLLLQMNPVHKKIPVLIHNGKPVCESLVIVRYIDEVWNHVSPLLPSDPYRRSQALFWTDYIEKTVYGVGRRIFIATGEEQEKAKEELIQFLKTIETELGEKLYFGGDSIGFVDVALLPFTAWFYTYETCGNFSIEESCPKLIEWVKRCTQKESVSKAIAHPHKIYDFFLEYKEKLGGN

SEQ ID NO: 27586 - protein, 263 aa, Haloarcula marismortui
MSGKDDYYNRAKQEGYRARSAYKLQQLDDTAGLLGEGRTVVDLGAAPGGWMQVAAERIGERGTLVGVDRQTIDDLEDPEPTVEYVRGDMTEDSTKDEIREIVGESDGSGGPVDVVISDMAPNMTGQYDLDHARSVHLVRQAFEVATDLLDAGGDFCAKVFDGQDLDDLIADIEPEFEYVREVRPDASRDSSSELYLVAKHRLTGPVREGDIVEATIEDIGEEGDGIAKVENFTVFVSGVEDGETVEVRIDDVKPRYAFAEPVE

SEQ ID NO: 27587 - protein, 93 aa, Glycine max
MSSRRSRSSQSDVSTEITDAQITDIISKLQQLIPELDARRSDKVSASKVLQETCNYIKSLHREVDDLSDRLSQLLATTDSNSAQAAIIRSLLL

SEQ ID NO: 27588 - protein, 435 aa, Xylella fastidiosa
MPHIRHLAQQCRDAARILATLSTDAKRRLLETMATALNTDAATILAANAADLDTARTQQVGTAMLDRLALDPQRLAAMADALRDIAALPDPVGQVTRDDRRPNGIHIQKIRVPLGVIAMIYEARPNVTADAAALCIKAGNGIILRGGSEAIRSNIAIATALQRALRLASLPETALILVQDMARHTMLELLQLSDLIDLVIPRGGEGLIRFVAEHARIPVIKHYKGVCHQFVDASADIEMAIRLLIDGKTTRPAACNALETLLVHTDIAPRFLPAAAAALRPYGVQLRGDHATCTLLPDVLLATDADYAAEYLDLILAIRIVPNLDAALEHIRRYGSDHTEVIVTADPAHADTFVQQLHSAVVMVNASSRFSDGGALGLGAEIGISTTRLHAYGPMGLDALTVERFVVRGQGQVRHCPLIHLHRDVSIANMPPITS

SEQ ID NO: 27589 - protein, 323 aa, Nicotiana plumbaginifolia
GEKNGIAKDVTELIGNTPLVYLNNVVDGCVARVAAKLESMEPCSSVKDRIGYSMITDAEEKGLIKPGESVLIEPTSGNTGVGLAFMAAAKGYKLIITMPSSMSLERRIILRAFGAELVLTDPAKGMKGSIQKAEEIKAKTPNSFILQQFENPANPKVHYETTGPEIWKGSNGKVDALVSGIGTGGTITGSGKYLREQNPDIKLYGVEPVESAILSGGKPGPHKIQGIGAGFIPGVLEVGLIDEVIQVSSEEAIETAKLLALKEGLLVGISSGASAAAAIKLAKRPENAGKLIVVVFPSFGERYLSSVLFESVRREAENMTVEP

SEQ ID NO: 27590 - protein, 907 aa, Oryza sativa
MTPAPAAASYRALVALLLVAVAVADDGSTLLEIKKSFRNVDNVLYDWAGGDYCSWRGVLCDNVTFAVAALNLSGLNLGGEISPAVGRLKGIVSMYGRRGGVLCCCLEMWLAGAWTRSNLILKNNQLIGVIPSTLSQLPNLKILDLAQNKLSGEIPRLIYWNEVLQYLGLRGNNLEGSISPDICQLTGLWYLDLSYNKLSGSIPFNIGFLQVATLSLQGNMFTGPIPSVIGLMQALAVLDLSYNQLSGPIPSILGNLTYTEKLYMQGNKLTGPIPPELGNMSTLHYLELNDNQLSGFIPPEFGKLTGLFDLNLANNNFEGPIPDNISSCVNLNSFNAYGNRLNGTIPPSLHKLESMTYLNLSSNFLSGSIPIELSRINNLDTFNLSNNGLVGFIPAEIGNLRSIMEIDMSNNHLGGLIPQELGMLQNLMLLNLKNNNITGDVSSLMNCFSLNILTVSYKGLAGVVPTDNNFSRFSPDSFLGNPGLCGYWLGSSCRSSGHQQKPLISKAAILGIAVGGLVILLMILVTVCRPHSPPVFKDVSVSKPVSNVPPKLVILHMNLSLLVYEDIMTMTENLSEKYIIGYGASSTVYKCVSKNRKPVAVKKLYAHYPQSFKEFETELETVGSIKHRNLVSLQGYSLSPVGNLLFYDYMENGSLWDVLHEGPTKKKKLDWETRLRIALGAAQGLAYLHHDCSPRIIHRDVKSKNILLDKDYEAHLTDFGIAKSLCVSKTHTSTYVMGTIGYIDPEYARTSRLNEKSDVYSYGIVLLELLTGKKPVDNECNLHHLILSKTANNAVMETVDPDIADTCKDLGEVKKVFQLALLCTKRQPSDRPTMHEVVRVLDCLVRPDPPPKSAQQLAMPQRPAVPSYINEYVSLRGTSVLSCANSSCTSDAELFLKFGEVISQNTE

SEQ ID NO: 27591 - protein, 608 aa, Magnetospirillum magnetotacticum
MCGICGYVGAERPGLIQAMIAEIRHRGPDGEGCDSALGIHLGHARLAILDPSHGAQPLTGADGRYTVSYNGEIYNYPDLRRELEALGHRFETTCDTELLPLGFAAWGEGLFARLDGMFAFALRDNADGRLWLVRDQLGIKPLYYSLAGGELAFASSARALTRHPQVSRRLRPDAIQEFLQFRWVRSGRHLFSDVEILPPGGVLRWTEGEARLDRFWTPARRGPARNALPRDWAAEVELVLEDSVRRQLRADVALGIFLSGGVDSAMIGHYAARNAANRLTAFTFSTGDRVDETAQAAAMARDFGFDHRVVSLTASDFADFPQAVACLDNPVGDAVVLPTWKLCREAAREVKVVLTGEGADEMFAGYAHLPILRKLDQLGSVAGVLRLLAPLIRLMPVGLLNHLFDYQASLGRLGRDAAAELLAVAGDSGKMLARASAIMGDAEMAQATTLGPPPPRPKADLSLGGLLLDLTRGWLPEEILHKMDQLSMAHGLEARVPYVTTALYDLLLRCPDQMAMGKTLLRHVASQSGLAAARRRKVAFHLPVETLWRPQLEEMCREYLSPAMIRRHAILNEAFVGRSLSLLKAGEFLASKRLVAMVSLHAWLDAHT

SEQ ID NO: 27592 - protein, 666 aa, Chlamydia trachomatis
MESLSVRSTIPLPLGAKKLSADRYRFSLFSSQAQQVTLVLLDPLSEIHEIPLSSTDHRTGAIWHIEIAGISSEWSYAYKLRGTDLSSQKFATDSYIADPYSKNIYSPQLFGSPKQEKDYAFSYLKHEDFDWEGDTPLHLPKENYFIYEMHVRSFTRDPSSQVSHPGTFLGIIEKIDHLKQLGVHAVELLPIFEFDETVHPFKNQDFPHLCNYWGYSSVNFFCPSRRYTYGADPCAPAREFKTLVKALHRAGIEVILDVVFNHTGFEGTSCPLPWIDLESYYMVNDHGDLMNFSGCGNTVNTNTPTTLKWILDALRYWVQEMHVDGFRFDLASVFSRDPQGVPLPLTPILQAISSDSILSETKLIAEPWDAGGLYQLGHFPSISTRWSEWNGCYRDHVKAFLNGDAHQVSSFASRISGSHDIYPNGKPTNSINYICSHDGFTLYDTVAYNDKHNEENGEYNRDGTSANYSYNFGCEGETTDPTICALRERQMKNFFLALFLSQGIPMIQSGDEYGHTAYGNNNHWCLDTKINYFLWDRLAERKELFSFLCQVIALRKAYTELFNTSFLSEDTITWLNTKGSPREWGADHYLAFELKHLNYSLFVAFYSGNERIEISLPKPRKEHLAYEKIVDSTTGFFSQILSPKLSLEPYSSLVAISRRKTSLESR

SEQ ID NO: 27593 - protein, 113 aa, Zea mays
  misc_feature (77)..(77): Xaa can be any naturally occurring amino acid
KENASREALEAAPIACNMYMTKYARKAALHLRCRFHPLHVLTLNKILSCALACRLQTAMRCALVKTEGTGARAGHLXQVLLLAGCMDNMAEHARESLLRAMITLTARHTIIVS

SEQ ID NO: 27594 - protein, 241 aa, Glycine max
IRLETLRIQRLRKKFYFHFQDYVDLIIWKVQFLDRHHLLIKFGSVDGGVSRNADHHPAFVAVYNMDTTEIVSFYQNSPDELYLLFEQFCDHFHATSRNSMYMNFISSHSNNIHALEQLRSIKDKASSSAQFVKKMLASLPFSCQSQSPSPYFDQSLFRFDDKLISATDRHRQSTDHPIKFILRRHPYSLKFKIKPGPEAGSMDGRAKKISSFLFHPILPLALSVQQTLFLQPSVVNIHFRR

SEQ ID NO: 27595 - protein, 306 aa, Zea mays
STAGCITSIVYLGAYDSEEAAARAYDLAALKYWGPETLLNFPVEDYSSEMPEMEAVSREEYLASLRRRSSGFSRGVSKYRGVARHHHNGRWEARIGRVFGNKYLYLGTFDTQEEAAKAYDLAAIEYRGVNAVTNFDISCYLDHPLFLAQLQQEPQVVPALNQEPQPDQSETGTTEQEPESSEAKTPDGSAEPDENAVPDDTAEPLTTVDDSIEEGLWSPCMDYELDTMSRPNFGSSINLSEWFADADFDCNIGCLFDGCSAADEGSKDGVGLADFSLFEAGDVQLKDVLSDMEEGIQPPAMISVCN

SEQ ID NO: 27596 - protein, 486 aa, Magnetospirillum magnetotacticum
MKIAVIEPLLQSRKNVIRDVIYGCWCGGKRIGGASVPPFEQLTVATILKHDGHEVCFIDAQQEQLSLEQVADRIQGSQLVITSTSVMTMRDDATFVRELKTRIPGLRAAAYGSHPTFKPEETLEKGYDFAIQREPEWVLRDLVRRLDAGDEDGAAHVPGIVTRGTDGTLIKNDRYPFIDDLDQIPPLDVGLLPRDYVYFNPIVRNLPYITVSSSHGCPAKCSYCTAPFFHGTRTRFMSAGKVLDDMAYYLNQGMREVYFRDETFTADRQRVMDICTGIIERNLRFSWICNARVDTVDPEMLGLMHRAGCHLIKFGAESGSQTVLDAVKKGITLQQTRDAFRWCSEAGIATHAHFMVGMPGETLETMEATLDLAIEIAPSTATFGICTPYPGTPLFRDVARLDESIGDGSDNASIERLHVEGDYNRHYCSVDGETLRRTVKRFYRRFYLRPAYVFDSLRRIRNGNMLRNAVIGGLNVIGFALGEKSS

SEQ ID NO: 27597 - protein, 264 aa, Sulfolobus tokodaii
MRIAIIQTYMTWDKKDNIERQVELVNKAIDNKAKIIALDELSNTIYFPFEQNPKYFSWAETERGETLQRFKEISKEREVSLIVPIFERDSNFFYNTAFILDNGEIIGKYRKTHLPQEEFFNEYYYFKVGDLGFPIFDLKGVKTGVVICHDRHFPEPVRVEVIKGAWLIFIPSVAAFKEIWELELKAHAVFNTVYIAGINRFGKEYPNQKEEYFGESMIISPIGEIVTKAEKNEEILYADISEDEVINARIKRPFLKKRLSSYGL

SEQ ID NO: 27598 - protein, 419 aa, Unknown
  Azoarcus sp. BH72
MQTVGREARAASRTLAAASTDAKNSALVAMAQAIRDSRDALLAANAADLAEARAAGLDEALIDRLTLSAKGVEGMAAGLEQVAALPDPVGEITDVKRRPSGIQVGKMRVPLGVVGIIYEARPNVTADAAALCLKSGNAAILRGGKEALRSNQAIASCVRTGLAAAGLPQTAVQVLETTDRAAVGALITMPEFVDVIVPRGGKGLIERISSEARVPVIKHLDGNCHVYVDDHADPAKVLPIVENAKTQRYGTCNTTESLLVARAVAPRFLSDIGRMLAARNVEMRACPEALALLREAGIEGARLSPATEQDWHEEYLAPIIAIRVVAGLDEAIAHINTYSSGHTEAILTEHYTHAMRFLREVDSASVMVNASTRFADGFEYGLGAEIGISTDKIHARGPVGLEGLTSQKWIVFGNGEIRR

SEQ ID NO: 27599 - protein, 312 aa, Sulfolobus tokodaii
MYNEWLPVAFSDEVKDVYETNVLGQDIVIIRKNEKLYGLSNRCPHRLAKLSKGKIIEDEIQCPYHGWRFNLEGKLTIVPSLGKKINVNLRKYYIKEKYGIIWVCINEPKDDLPEIKEWESFRKIKCGPYYINANPFRVLENLFDVSHFPYVHENYLGDPKYPYIPEYNVEITNEGIVAKNIKIYQPNPDGSHAEKYESYTYIIYRPLFLYFTKTDESERTFSMIFAIKPESKNKSVVFAWIFMNYDYETDENVIRNFEDTIIMQDKEVLETQPDIYYLDLSKEIHVKADKLSIFYRHYLKRRIGKFPELGLL

SEQ ID NO: 27600 - protein, 236 aa, Unknown
  Synechococcus sp. WH 8020
MFDSFLNELHSDITKRGGSPLPLPEGLEECRSSKSSSVIQSWLWDVPGFRRWRVTRLDAGDSLQVFNSVAYPDYNYDHPLMGVDLLWFGARQKLVAVLDFQPLVQDKDYLDRYFSGLKELNQRFPDLNGEETMRSFDPNQYFSSWLLFCRGGAEQADLSLPKAFSAFLKAYWDLHDNAKSIPSTIPPEEVKNLQDKYDIYSAERDPAHGLFTSHFGKDWSNRFLHEFLFPASSSHK

SEQ ID NO: 27601 - protein, 181 aa, Methanosarcina barkeri
MEENQNAELNPDYFENPGSDLKKATFAAGCFWGIEEAFRQVKGVVATAVGFSGGHFERPTYEQVCTLDTGHAEAVRVIFDPKVVSYETLLDVFWKIHDPTTKDRQGPDVGKQYRSVIFYHDEKQKASALASKEKLEKSGVFKNPIVTEVVPVSEFYMAEEYHQQYFEKKGFLQNILRGLKK

SEQ ID NO: 27602 - protein, 236 aa, Ashbya gossypii
MGKAEFGTAKYISNQLKARGLQKLRFYCQICQKQCRDDNGFQSHIKSPSHLRKISTITPKDIDQYTKQFERDFLRLLHMGHGEKKIEANKFYNEYIQDKHHIHMNATRYTSLTKFIQHLSKTGKIRVHGVEELEEDMDPGQILISYIDNSSDNMLKKDKLRELEENDKHEEDIRQNMLLKQIEFGKKAEQLADVPASDEVPGAEKPAVIGKVSLRLETKNKVKKKKSKGTNVFKKA

SEQ ID NO: 27603 - protein, 162 aa, Trema tomentosa
MSSSEVDKVFTEEQEALVVKSWAVMKKNSAELGLKFFLKIFEIAPSAKNLFSYLKDSPIPLEQNPKLKPHAMTVFVMTCESAVQLRKAGKVTVRESNLKRLGAIHFKNGVVNEHFEVTRFALLETIKEAVPEMWSPEMKNAWGEAYDQLVAAIKSEMKPSST

SEQ ID NO: 27604 - protein, 76 aa, Glycine max
MGRRPRGLICRFKSKPYPKSRFCRGVPDPKIRIYDVGMKKKGVDEFPFCVDLVSSEKENVSSEALEAARIACNKYM

SEQ ID NO: 27605 - protein, 79 aa, Arabidopsis thaliana
MASQTPNHECRMYEAKYPEVAIAVMIQVKNIADMGSEVALREYEIIDGMILFAELSQPQIGSVNTLITVGRSETVTVHR

SEQ ID NO: 27606 - protein, 376 aa, Unknown
  Candidatus Pelagibacter ubique HTCC1002
MAKRDFYDVLGVSKSASPEELKSAYRKLAVKYHPDKNPGDKASEDKFKEAGEAYGILSDKEKKQNYDNFGHAAFEGGGGRQGGGFGGGFGGADFSDIFEDFFGDFGGGQSRGRRKTNNRGSDLRYDLSITLEEAYEGKKQDIKFSTTEKCNTCSGNGSKPGHSPDRCTVCGGNGKVRSNQGFFTVQQTCPQCAGSGEEITNPCTDCNGQGNKQASKKISVTIPKGVDDGTRIRLAGKGEAGSKGGANGDLYLFVNVHSHDLFKRSDENLFFEFPISIADAALGTTIEIPTIDGGKAKIKIPDGTQNGKQFRLKGKGMPYMRGSGNGDLYVQVNTEVPISLNKEQKALLEKFREIENEKSNPSIKQFFQKAKSFWKN

SEQ ID NO: 27607 - protein, 305 aa, Bacillus anthracis
MKLCENITELIGDTPVVRLSKFIPEDAADVYVKLEMFNPSRSVKDRAAYNLLHVAEENGLIKPGDTIIEPTSGNTGIGLAMNAAAKGYKAILIMPDNMSKERINLLKAYGAEVVLTPAEQRMPGAIAKALELQKEIPNSFIPQQFENPANPNIHRYTTALEIYEQMDGELDAFVATAGTGGTITGTGETLKEKLPNLYIAVVEPKGSPVLSGGVPGPHKLVGTSPGFIPKNLNTEVYNEIIQIADEEALTTMRNLARQEGLLVGPSSGASVYAAIMIAKRLGTGKKVLCVAPDTGERYLSMGLFE

SEQ ID NO: 27608 - protein, 829 aa, Unknown
  Shewanella sp. MR-4
MNRRDFIKANAVIAAAGAAGLALPASASNLITSSEQTKLEWNKAPCRFCGTGCSVIVATRDGKVVATHGDANSEVNRGLNCIKGYFLSKIMYGSDRLTTPMLRMTDGKYDKHGEFTPISWDSAFDIMAQKWKETLKAKGPTAVGMFGSGQWTVWEGYAAVKLMKAGFGSNNIDPNARHCMASAVVGFMRTFGIDEPMGCYDDMEAADAFVLWGSNMAEMHPILWTRVTDRRLSASHVKVAVLSTFEHRSFDLADLPIVFTPQTDLAILNFIANYIIQNDKVNWDFVKKHVNFRQGTTDIGYGLRPTHPLEQKAKNVKTAGDSTPIDFDTFKAFVAEYTVEKVSKMSGVPEAKLIELAKLYADPNTKVTSFWTMGFNQHTRGVWCNNLIYNIHLLTGKISTPGNSPFSLTGQPSACGTAREVGTFSHRLPADMVVTNPEHRKHAEEIWKIPSGIIPPKPGYHAVEQNRRLKDGDLNCYWVQVNNNMQAGPNINEEGLPGYRNPANFIVVSDAYPTVTTQAADLILPTAMWVEKEGAYGNAERRTQFWHQMVQAPGESHSDLWQLMEFSKRFTTDEVWSKEVLAANPQFKGKTLFEVLYQNGNVDKFPLADTDPKYLNNEAKHFGFYVQKGLFEEYATFGRGHGHDLAPFEAYHEAHGLRWPVVDGKETKWRFREGSDPYVKAGTGFEFYGKPDGRAVIFALPFEPPAESPDDEYDMWLSTGRVLEHWHSGSMTQRVPELYRAFPDAVCFMHPEDAKKRGLRRGDEVRVMSRRGEIKTRVETRGRNKPPVGLVFVPWFDASQLINKVTLDATDPLSKQTDFKKCAVKIVKV

SEQ ID NO: 27609 - protein, 246 aa, Solanum lycopersicum
MASNTLMSCGIPAVCPSFLSSTKSKFAAAMPVYVGATNFMSRFSMSADWMPGQPRPSYLDGSAPGDFGFDSLGLGEVPANLERYKESELIHCRWAMLAVPGIIVPEALGLGNWVKAQEWAAIPGGQATYLGQPVPWGTLPTILAIEFLAIAFVEHQRSMEKDSEKKKYPGGAFDPLGYSKDPAKFEELKVKEIKNGRLALLAIVGFCVQQSAYLGTGPLENLATHLADPWHNNIGDVIIPKGIFPN

SEQ ID NO: 27610 - protein, 478 aa, Unknown
  Oceanobacter sp. RED65
MSSFNAVWFRRDLRVHDNPALFHAMKNGQCIAFYCLAQKQWDEHQVSLRQRSLIRQQLEDLTQSLAALGVPLIVIDTADFKSIPKTFVSVLQQYNVEQLFCNAEYEVNEVALTKNVTEALQQQDIKCHEYHDQCLIQPGVIVNKQDQPYKVFTAFKKAYLAQLDIYMRDLYPLPKKQQAPKVKTDISALQSIAQVDIDPWQGSEQVALDALDEFCKDRIKAYKRDRDIPSLDGTSTLSPYLAIGSLSVRQCWQMSQQVSPSGSKPEGIATWQSELIWRDFYRHLIYFFPHVCQYKAFKQETDHLPWKKDQALFQAWCDGRTGYPLVDAAMRQLNQTGWMHNRLRMVAAMFLSKHLFIDWRLGEAYFMQQLIDGDLASNNGGWQWSASTGVDAVPYFRIFNPIRQSERFDSKGTFLRQYVPELASLDDKRIHNPDPITVKKLGYPAPIVDHKQAVVQTKQWFKELDASNKEFYSQESLI

SEQ ID NO: 27611 - protein, 355 aa, Legionella pneumophila
MMLYICSSWKKNKKQLELKTRLFLTKMNKKTIAMLGAGSWGTAVAIHLAKIGHKTLLWSHNPQHVALMAEQHSNPAYLPGIPFPENLIPSDNLIECVQSADYVIIAVPSHAFAEIINKIPKPTQGLAWLTKGVDPASHELLSQLVASRFGVDFPIAVISGPSFAKEVARFLPTALTLASNNTNYQKKMHQLFHHDNIRVYLSDDLIGVQLCGAVKNILAIACGISDGLGYGANAKAALITRGLAEMTRLGLSMGARQDTFLGLAGVGDLVLTCTDDQSRNRRFGLLLGREVPIPEAEHQIGQVVEGKHNAAQICAIANKNKVEMPICEQINALLHGIVHAQEAVNNLMSRPAKEE

SEQ ID NO: 27612 - protein, 255 aa, Cucumis sativus
PTLAGQAVKLSPNAPEIQGNAKFTMRKTASKSVSSGSPWYGPDRVKYLGPFSGEPPSYLTGEFPGDYGWDTAGLSADPETFAKNRELEVIHSRWAMLGALGCVFPELLSRNGVKFGEAVWFKAGSQIFSEGGLDYLGNPSLVHAQSILAIWACQVVLMGAVEGYRIAGGPLGEVTDPIYPGGSFDPLGLADDPEAFAELKVKELKNGRLAMFSMFGFFVQAIVTGKGPLENLADHLADPVNNNAWAYATNFVPGK

SEQ ID NO: 27613 - protein, 126 aa, Methanosarcina acetivorans
MKWDRGYLLVVAMKYIIAMIRPEKLDAVKRELQKVEVNRLTVSSVSGYGAQKGQLEIYRAMEFEADLLEKIKIEIAVNDEFLYPTIEAIKSGAKGSEGHIGSGKIFVLPLEDVIRIRTDESGPVAI

SEQ ID NO: 27614 - protein, 379 aa, Mycobacterium tuberculosis
MTDRGENRTTIAMLETAGLWGKRADMIVRGCLPYNAEPPPAVLAGSDITPINAFYVRNHGPVPDIAPQHWRLTVGGLVDNPLTVTYERLTTEFDQHCVVATLACAGNRRAELLRVRQIPGKEPWAHGAISTAQWCGVRLADILQAADVHIDEGLHVAFDAPDVAEEARPIQPYGSSIPLSKALSPEVLLAWQMNSEPLPRAHGGPVRVVVPGFIGARSVKWVTAITVQPGASQNYFQALDYRILPADADADIVGPGEGISLSSLALNCDILDPTDGDDVPAGALTIRGYGMAGDGRSVERVDVSVDDGLTWQQADLHAAPSQWSWRPWSLTVDVEPGPLGITARAWDDTGALQPESAVSLWNPRGYGNNAWARVALRVS

SEQ ID NO: 27615 - protein, 1552 aa, Aspergillus nidulans
MNPSSALMPKATAIPGCILRTSRQCSKHNQTSGIRASSSTRQYHVAAIESPARRRRDSTFMKRSDFIQARNFHATKVLAAIPDPYKVLGVDKGASAGDIKKAYYGMAKKYHPDTNKDPGAKEKFAEAQSAYELLSDKKKRETYDRFGSAAFDQNGGFDPSAGAGGNPFAGGGGFHGFGGGFGGGFPGGFAADINIEDLFGAFAGGARRSGRGRRGPFQEILVGEDIEVQTNISFMEAAKGTSQDIVITPLKECGTCKGDGLKEGAKRTQCRQCNGTGTRVHLMQGGFQVAATCDACGGAGLIVPRGSHCGTCKGDGVVRERKTVRVDIPGGVEDGMRLRISGEGDAPPTGTAAAPGTRTQRGDLYVSIRVSPDERFSRSGSDILYTASIPLTTALLGGEVLVPTLDGQVKVKVATGTGTGDRITLSGMGMKKLGGRSRGFSPNGDLKVEFKVAMPKYLTSNQRTILEVLADEMGDKTARRIMDIPRDGLSTAPAADASSGNESKSEGFLKSAWHKLMNHKKPAGSENSSDSSSNKDSNSSGDNGSSPLHDGKMVQSPMISCPLKQTNEIDWIQPLKDYIRQSYGEDPERYSQECATLNRLRQDMRGAGKDSATGRDLLYRYYGQLELLDLRFPVDENHIKISFTWYDAFTHKPTSQYSLAFEKASIIFNISAVLSCHAANQNRADDIGLKTAYHNFQASAGMFTYINENFLHAPSTDLNRETVKTLINITLAQGQEVFLEKQIMDHKKAGFLAKLASQASYLYAQAIEGTQEHAKGIFDKSWVTLLQVKSAHMGSVASYYQALADGESGSHGVAVARLQLAEKHSTSALSWAKSLPSSISPNTNLTSEAGPSLVDIVKFHLANVQSQLATFVKDNDFIYHQPVPSEAGLSAVSKLPAAKAIPVSELYQGQDIQRIIGPDIFQKLVPMSVTETASLYDEEKAKLIRAETEKVETADGEMAASLDYFKLPGSLNILKGGMDQEVMVDEEFQRWCQELAGHDSFAKAFDTLQDRKSEVLATLDQCAKQLDLEESVCEKMRSKYGADWSQQPSSRLNMTLRNDIRTYRDTVHEASASDAQLSATLRQYESDFDEMRSAGETDEADVLFQRAMIKAGSKQGKTKNGVTSPYSATEGSLLDDVYDDGVPSVAEQIARVESILKKLNLVKRERTQVLKDLKEKVRNDDISNVLILNKKSITGQESQLFEAELEKFHPHQMRIVQANHKQTALMKELTKTYGDLLQDKRVRAEQSKYESITRQRNSVMARYKKIYDSFNNLGSGIKQAQTFYAEMTETVDSLKKNVDTFINNRRSEGAQLLGQIEREKAAGTSDHEEREREKLRQLMERLSTEPKPPSVPPGSSTAGPAKAKSPPPPVKAPAYPTNIAPPKASPHFAPTVPQQHGTPVSHSPAPYSQYVPPGAGVSYLPSQSFQQGAAAPLSEGYNPMAYPIPASSMSPPPSQPFYSPTPTPFYTSPTPPVPSGQYMPQGYVPPPPPPRPQQPTYPPSTGPFPSGPGGYAQSRPYGSSQHHKAHSQSSPQTGPSVSANSSDPWAGLNAWK

SEQ ID NO: 27616 - protein, 348 aa, Candida albicans
MNEDPQSEIMERYNESAYLRDDQLPQFDQNNDVIKEEQTHTQDHHHQHPSVSGSHSDELQDQDIHNVIEEHEDHVSTQNIVDEDELLAAQAAAEAAAAAQQQQPGDVFNNVAQGLSGKHRDMMMQYWQETINSIEHDEHDFKNHQLPLARIKKVMKTDEDVRMISAEAPILFAKGCDVFITELTMRAWIHAEENKRRTLQKSDIAAALTKSDMFDFLIDVVPREEEKPKKSNNNSSRSDSYVNNQQSPPIPETEEEVPHMLTQDVKHSHQDVLQQQMLQEQLLQQQLHQEVQQQLQQEVQRQLQEDVPQSDHQQASQREEDITNGAENANGHNDEATYENFNGYQNNY

SEQ ID NO: 27617 - protein, 122 aa, Unknown
  Azoarcus sp. BH72
MLRVGDLDRSLAFYTEVLGMRLLRRNDYPDGKFTLAFVGYQDEADGAVLELTHNWGVERYELGTAYGHIALEVPDAAKACDEIRARGGKVVREAGPMKHGSTVIAFVEDPDGYKVELIERRA

SEQ ID NO: 27618 - protein, 716 aa, Oryza sativa [sequence omitted]

SEQ ID NO: 27619 - protein, 666 aa, Phaseolus vulgaris
MAAISCILSLLLSSLIAQVSAQFNTEYCDNNKGNYTINSTYHNNLNTLLSTLSSHTQINYGFYNFSHGQNNDKVNAIGLCRGDVKPDECRRCLNDSALTITQLCPNQKEALLWLNTSKCLLRYSHRTIFGVMESSPGFYLTNVNNVTEADKFNQALSNLMRNPTVVAASGDSRLKYAADSAIAANFQTVYGLVQCTPDLSETDCNRCLDGAISEIPSCCGNKMGGRVLRPSCNIRFESAIFYDSNAKLDPDVTPPSPPPSSFTNTSPKESNNTITIVIAVVVSIVVVAVVSLLGLCIYLRRKKARKSPTVNQDDDDDDIEISQSLQFDFDTIRVATEDFSNSNKLGQGGFGAVYRGRLPNGQMIAVKRLSSGSSQGDTEFKNEVLLMAKLQHRNLVRLLGFCLEGRERLLIYEFVPNKSLDYFIFDPVKKAQLDWEMRYKIIRGIARGLLYLHEDSLLRIIHRDLKASNILLDEEMNPKIADFGMARLVLLDETHANTNRVVGTYGYMAPEYIMQGQFSVKSDIFSFGVLLLEIVSGQKNSGFRHGENVEDLLSFTWRNWRDGTAVNIVDPSLENNSRNEVMRCIHIGLLCVQENLTDRPTMATIMLMLSSYSLGLPIPSEPAFYANSTARSLPATSSWGHSSRATANQSAQESENENSITEPYPR

SEQ ID NO: 27620 - protein, 306 aa, Listeria innocua
MQKKAMIIYNPAAGKNKFRKLLPDAEKILTNADFEVTLVPSTPAPKSTTLIAKQAAEAGYEVVIAAGGDGTVNEVVNGLMQVEKRPKLGILPVGTTNDYARALNFAKDPLEALQIIAKQETIRVDIGKANETEFFINNAAGGRITEITYAVKESMKSKWGRLAYLFSGLTVLPKLSPVNVEIIYNEEIFKGEILLFFVNKTNSVGGMETLCPPAQLNSGMFELLILKKVSPKKLFQLFASIKKGTHLNSPHVIHARTNKVTIKSDADLNVSYDGVYGGKAPYTLEVIPEALEVFADEKRISARLRG

SEQ ID NO: 27621 - protein, 181 aa, Brassica rapa
MAYSMLSSAAVVTSPAQATMVAPFTGLKSSSAFPVTRKANNDITSIVSNGGRVSCMKVWPPVGKKKFETLSYLPDLTEVELGKEVDYLLRNKWIPCVELELEHGFVYREHGSTPGYYDGRYWTMWKLPLFGCTDSAQVLKEVQECKTEYPNAFIRIIGFDNNRQVQCISFIAYKPPSFTGA

SEQ ID NO: 27622 - protein, 316 aa, Bacillus licheniformis
MSEEKMYDVIIIGAGPAGMTAAVYTSRANLSTLMVERGVPGGQMANTEDVENYPGFESILGPELSNKMFEHAKKFGAEYAYGDIKEVVDEGDYKIVKAGSKEFKARAVIITAGAEYKKLGVPGEKELGGRGVSYCAVCDGAFFKNKELVVVGGGDSAVEEGVYLTRFASKVTIVHRRDKLRAQSILQARAFDNEKVDFLWNKTVKEIHEQDGKVGKVTLVDTVTGEEEEFRTDGVFIYIGMLPLSEPFKNLGITNEEGYIVTNEQMETKVEGIFAAGDIREKTLRQIVTATGDGSIAAQSVQHYIEELKEKEKAVK

SEQ ID NO: 27623 - protein, 211 aa, Oryza sativa
MSAQIAPAEQVCYVHCNFCNTILAVSVPGNSMLNIVTVRCGHCTNLLSVNLRGLMAPPPAAAAPPCRPAGPPRPAAAPAGRRHKPPPHRAPRRNILMLDFGYPEFGFSAASSSSKLRLPPAAAAMVSYSQQNQQLEQALHARPPEKRQRVPSAYNRFIKEEIRRIKANNPDISHREAFSTAAKNWAHYPNIHFGLSPGHEGGKKLVDVDPI

SEQ ID NO: 27624 - protein, 270 aa, Brassica napus
  misc_feature (198)..(198): Xaa can be any naturally occurring amino acid
MSQLLSSPLMAASYSPFTSPRFLSSSSSSVLVAGGGLAVKRHGLASKPVRTVNLSVKSRQSDYFEKQRFGDSSSSSSQNGEGGPARFYVGHSIYKGKAALTVEPRAPEFVSLDSGAFKLSKDGFLLLQFAPAAGVRQYDWSKKQVFSLSVSEFGTLVSLGPRESCEFLSLILNKGKSGEGKVRKGVGKLKPLPDGSGXFFNLSVQNKLLNVDENIYIPVTRAEFAVLTSAFNFVLPYLIGWHAFANSIKPEEGNRTSNASPNYGGDYEWN

SEQ ID NO: 27625 - protein, 649 aa, Coccidioides immitis
MSFPFASVTSYSPRLRQYANALLTPVLPATQTPASRTTKRGTAAINYAENDIDEEDFDDSDSTRRPTGLRSLKREDIHPDRGPTGEKLGTEIFAPANVQPNFREWLLRRRPKAMKEVQLTGYGLLPLNLVPIRIDLEVPAHQPLEPFPLPRNYLELGINPTAPAYRKPEAAPPYRIKDFILWNLHEPFITPEEYAVTFVRELDLPNLPMMVTAVCNQIRQQLEEYAGVAMHPIFQKIPASKNTLSRTQYIPESPTPAQISATTPANQADAAGKQAISQGVSSDDNSFNTDDAYRCIVILDITLQNKLYTDKFEWSLLHDQGLADQFARMTCADLSLGPEWVNVISHGICETVLKLKKEACESGGLVGIGGDGAEIDNLAANGREAGWRYDPDGLGDEWEPRVQILSKEDIEKREGDRERQIRRLRRETARFSSTANMSLDMTRQSSGGYFDLPDPDTPLGRGERNKRRRRARSNSPASGTPGGRDKAGDAPIAPGQDTPLGPREMGLRGQRFSAKIAEWNMNGTAGYQRGRRTFLPLDEFSHNVHLSCVLREILICTLFLLWTKLVQTGLSGTLFTVCCTQNGFVWRLNQKEGFFRSAGAALATGRLFYLAWYSGIRGCLMGVYGDSRRISSLFMFPTGSQHENCPKLI

SEQ ID NO: 27626 - protein, 473 aa, Oceanobacillus iheyensis
MSPITKYFNGMSYRSVFLYSIFIILFVAFSFTRSLEYEAKVTLIIFIIAMVLWVATKLPAGYVALGSLLSIILLKGASTSLLYESFSLEIVWLMIGAFMIGEAVKRSGLADRMMNSILHRSTSYNGLLFYVMVALFPLAIFIPSTSGRAALTLPVVKELGRRIKDEKQKQTLALFVPIIILMSTSATVIGAGSHLIGIELLNQTTGDSISYFNWLIWGLPFALFISLVTYFVIKLYMVRQGSNPVSTEIVSDSVEHEKKAMTKKESQTLIIIGILVLLWLTEAVHGYEIGFITILGAIVLMTPKYGLISWRQGIKAVSWNLIIFVSAATALGINLVETGVVGWVEEHIFQFISTYSGFSHWGILCVILLISITSHLYVTSHTTRAIVFLPGFLMLSTSLDLNATAVLFLSLIGMNYCVTFPVSSKALLVYFEQEEMNFEARDLIKLSMLLMPVYFISMLIFYYTYWSWTGLSL

SEQ ID NO: 27627 - protein, 176 aa, Manihot esculenta
MASSMLSTATVASINRVSPAQATMVAPFTGLKSTPVFPTTRKTNSDITSITSNGGKVQCMKVWPTLGMKKFETLSYLPPLTREQLAKPSCIGPCLEFELEHGLVYREHARVPGYYDGRYWTMWKLPMFGCTDAAQVLKELDELIKHHPDGYARIIGFDNVRQVQCISFLAYKPPGA

SEQ ID NO: 27628 - protein, 184 aa, Manihot esculenta
MATSMLSTATVASINRASPAQASMVAPFTGLKSTSAFPATTKTSADITSLASNGGRVQCMQVWPTRGKKKFETLSYLPPLSREQLASEIDYLLRSGWIPCLEFELEHGFVYRAHGSLPGYYDGRYWTMWKLPMFGCTDSSQVLKELDELIKAHPDGFARIIGFDNVRQVQCISFIAYKPPGTDY

SEQ ID NO: 27629 - protein, 398 aa, Mycobacterium avium
MLGIVLAGGEGKRLYPLTADRAKPAVPFGGAYRLIDFVLSNLVNARYLRICVLTQYKSHSLDRHISQNWRLSGLAGEYITPVPAQQRLGPRWYTGSADAIYQSLNLIYDEDPDYIVVFGADHVYRMDPEQMVRFHIDSGAGATVAGIRVPRSEATAFGCIDSDESGRIRKFVEKPLDPPGTPDDPETTFVSMGNYIFTTKVLIDAIRADADDDHSDHDMGGDIIPRLVDDGMAAVYDFSDNEVPGATDRDRGYWRDVGTLDAFYDAHMDLVSVHPVFNLYNKRWPIRGESENLAPAKFVNGGSAQESVVGAGSIISAASVRNSVLSSNVVVDDGAIVEGSVIMPGARVGRGAVVRHAILDKNVVVGPGEMVGVDLERDRERFAISAGGVVAVGKGVWI

SEQ ID NO: 27630 - protein, 525 aa, Bambusa oldhamii
MEEGRSDLKEASRLERALSAESGGGGGDSGSDSGRKKFMRLLRLFFACMVSGGIQYGWALQLSLLSPYSQTLGISHTYVSLTWICGPISGFVVQPIVGYYSDRCTMRIGRRRPFILAGCLVICISVMLIGFSADIGRRLGDTKEHCSTYTGPRWSAAIVYIAGFWFLDFANNTVQGPARAMMADISAGHHGPSVGQAIFSLWMAIGSILGYLAGANAKWHEWFPSLKTAACCDACANLKGAFFTAVALIVISMTVTMLLADEKPLYKVDVDTSSGGGWSAFGDLFKSFKNLSPAMFKVLAVTAITWLSWFPFFQYNTDWMGREIYHGDPHGKGVKADSYNAGVREGAVGLLLCSISLGVTSFLIPKLCRKLTSKVVWSISNFLVFIIMTVMVVVGMVSMKGYRPSLSATLTGSDPTLKAIALTIFALIGVPQAVLFSVPWVVASEVAAEEGGGQGLTVGVLNIAIVVPQLIIALTAGPIDGAFNKGNTPAFGIGGAFAFICAVLALFLLPKTRGISHAAVVASGH

SEQ ID NO: 27631 - protein, 512 aa, Oceanobacillus iheyensis
MLNDKAIRQSKIIYWSSGIVSICGIIFEVLFGALGSYILGDGVKQYTLTISLFLTGMGIGASLSEKFMRNLIIKFVWIEFCVALIGGFSSFIMFGITAFAPAGTDAFYLYSITLIIGALTGVELPILIRKANEIGVTLNKSTARVLFSDYAGGLIGGVLFVFLFRPYFGMVKTAFLVGLINLTVALIVLWLFRKEIRHFIVHAVIGGVIGVLLIAGLFFGEEMAFNFEQKLYQDPIIHMEESSYQKITVTQDEKDIRLYLDGSLQFSSVDEHRYHEVLVHPAMANVETPENVLILGGGDGIAAKEVLKYQDVKQVTLVDLDPAVVELANENRHLLEINEGALMDEKVEVKNMDAFQFLEDTSEWYDVILVDLPDPNNESLNKLYTKEFYSLVRNHLKPEGTLMVQATSPVFAREVYWTISETISSTNLNTENLHVDVPSFGNWGFVMASREEIDLDIMEIPVSTRFLTDDMMPALTAFGKDEDQQIPNFELKANTLIDPHLIQIYEKAWENY

SEQ ID NO: 27632 - protein, 517 aa, Oryza sativa
MSTSVEGSMYPPHLTDAERDNLVLTIKDWSIGNGLAIRPPPAVIPTDADPSGIAAINAPVTLFPSAFPRICFEQGKAVQQTYNDLYAAVSRDEEFLAQIVKEVADGDDFIRNLWQIHLKVKQEGYTQPLSLGLFRSDYMVHQDTSTSPPSLTAKQVEFNTIASSFGGLSCFTSRLHRYLAATEYPLIDEAIPAGSLNLPESTAVQGLAGGIEAAFHAYPPSELGHPKCIIFLVQGDERNVFDQRHLEYQIASSSPTAPVFRLAFSDILTHTTVADTPKRQLLYRLPRNPAKVFEVAVIYMRAGYGPGDYPDQRAWDARYHLERSAAIKCPTVLTQLAGTKKVQQVLATPRPSSAPSMLGRFIKDDTPAAAELWRTFTNIYPMDTSEAGLEARKKALDPEACQAYVLKPQREGGGNNIYRGAIPSFLKSVPEEHWGSFILMELITPPPVSNTILRNGKIEQGGVICELGVYGTCLWNQSSGEVLRNEEAGYLLRTKGDKSEEGGVAAGYGCMDSCSLV

SEQ ID NO: 27633 - protein, 178 aa, Bacillus anthracis
MSEKTYELATFAGGCFWCMVKPFDELPDIHKVLSGYAGGHVENPTYEQVKAGTSGHLEVVQITFDPSIFPYEKLLNLYWPQIDPTDDGGQFFDRGPSYRTAIFYHTETQKELAEKSKHSLAESGMFKDPIVTEIRPAAPFYEAEEYHQHFYKKNPEKYATEQKESGREDFIKENWQKK

SEQ ID NO: 27634 - protein, 749 aa, Aspergillus nidulans
MAKKPYIPPLIGWLYDLVLWTFSVLVDLFFREVHPRGSWKIPRRGPMIIVAAPHANQFVDSLILMRVLRTEAHRRISFLIAEKSFRRKFIGLLARGIGTVPVARAMDMLKPGQGTVYLPDPVNQPTLLRGVGTNFEAPGFEKDGTIALPTINGTSHSTSIAEIRGPEELILKKPFTHKDALFQLTGRTDITDDGTFTGDVSDKDRADFKGSKFKAAPHVDQSAVYEAVFGRLLGGGCIGIFPEGGSHDRPDLLPLKPGVALMALGTLAENPDCGLKIVPCGMNYFHAHKFRSRAVIEFGTPLEVPKELVEKYKNGDRRGAVGPLLEMIYQSLVAVTVTSPDYETLMVIQAARRLYNTKGKKLPLPMVVELNRRLVKGYSHFKDDPRIVDLKKSIADYNKQLRLLGIRDHQVEYAKFSFVKVIATLIYRLGKLALLTIGTLPGLLLFTPVFITTKLISNKKSKEALAASTVKLQGRDVMATWKLLVALAFAPALYAFYTAAFTYWAYRNRINGYVPDFVPLWSFIPIGMVLFPTITFAALRIGEIGMDIIKSLRPLLLSLNPSSANTLVKLRLRRAALAKQVTDTINTLGPELFPDFDAARIVTDPFRELNRQSANPEGEQRPPSVEIRRASTENFDEGSPSQEPLPRNESFHNLANFGFFSTRPSSRNRSRSNSRSSSFGGLPGTSGQQLKPLSQLTTKGGFDEVSSKIRDAMRERGVQRRRRSEDNSSWDMASSGPGTPHSEDNRKDI

SEQ ID NO: 27635 - protein, 153 aa, Arthroderma benhamiae
MQIFVKTLTGKTITLEVESSDTIDNVKTKIQDKEGIPPDQQRLIFAGKQLEDGRTLSDYNIQKESTLHLVLRLRGGMQIFVKTLTGKTITLEVESSDTIDNVKTKIQDKEGIPPDQQRLIFAGKQLEDGRTLSDYNIQKESTLHLVLRLRGGN

SEQ ID NO: 27636 - protein, 389 aa, Robiginitalea biformata
MAPYIYMERNGIHVINLYKTVAKLDEAGEALKKIAASGRKILFVATKKQAKDIVAQKVAEVNMPYITERWPGGMLTNFVTIRRAVKKMASIDRMKKDGTFNTLSKKERLQVDRLRAKLEKNLGSIADMTRLPGALFVVDTMREHIAVKEAQKLNIPIFAMVDTNSDPRPIDFVIPANDDASKSIEVIMSQVTQFVADGLAERKSEKSAEKEGRDADTDVVEKAPAVAKTDKAPAPAKQTKEIESEPVVEQEKPAEKQVKAENAAEPETVKSDSPVEQPKAAEKEQKEEGKAPAKKEAAAEKATDSKAEDLTKIEGIGPKAAEALTKAGVSTYSALAGTKPDAIKEILTEASSRMAHLDPESWPKQAKLAADGKWEELAEWQEKAKGGVE

SEQ ID NO: 27637 - protein, 266 aa, Petunia sp.
MAAATMALSSSSFAGKAVNVPSSSEITRNGKVTMRKTVTKAKPVSSGSPWYGPDRVKYLGPFSGEAPSYLTGEFPGDYGWDTAGLSADPATFAKNRKLEVIHCRWTMLGALGCVFPELFARNGVKFGEAVWFKAGSQIFKEGGLDYLGNPSLVHAQSILAIWACQVVLMGAVEGYRVAGGPLGEVIDPLYPGGSFDPLGLADDPEAFAELEVKEIKNGRLAMFSMFGFFVQAIVTGKGPLENLADHLADPVNNNAWAFATNFVPGK

SEQ ID NO: 27638 - protein, 110 aa, Glycine max
  misc_feature (86)..(86): Xaa can be any naturally occurring amino acid
MASSMIWDRAVTTVNRAGAGMVAPFTGLKSMAGFPTRKTNNDITYIASNGGRVQCMHVWPPIGKRKSRLFSTWQNLVNPNLPKEVXFLLRKGWIPCLEFELEHGFLYRGP

SEQ ID NO: 27639 - protein, 266 aa, Pinus thunbergii
MATASAIQSSSLAGQTLLRPQQNELVKKVGTAQARITMRRTVRSAPESIWYGPDRPKYLGPFSEGTPSYLTGEFPGDYGWDTAAVSADPETFAKNRELEVIHCRWAMLGALGCVFPELLAKNGLKFGEAVWFKAGAQIFSEGGLDYAGNPNLIHAQSILAIWACQVVLMGLIEGYRVGGGTLGEGLDPLLPGGAFDPLGLADDPEACAELKVKEIKNGRLAMFSMFGFFVQAIVTGKGPIENLYDHLADPVANNAWAYATNFVPGK

SEQ ID NO: 27640 - protein, 212 aa, Corynebacterium efficiens
MRTLEQRRCTLHMVNNVEMAGEKDFNVPTNPYGDDIESVLISENKLKERIREMAARVSEDYRDSEEDLILVCVLKGAFYFLSDFSRELTIPSQSEFMAVSSYGNSTSSSGVVRILKDLDKDIEGRDVLIVEDIIDSGLTLSWLMRNLKNRHPKSLNVITLLRKPERLTANIDMYDIGFDIPNEFVVGYGLDFAERYRDLPYVGTLEPRVYSD

SEQ ID NO: 27641 - protein, 124 aa, Raphanus sativus
LDYLGNPSLVHAQSILAIWATQVILMGAVEGYRVAGDGPLGEAEDLLYPGGSFDPLASLTDPEAFAELKVKEIKNGRLAMFSMFGFFVQAIVTGKGPLENLADHLADPVNNNAWAFATNFVPGK

SEQ ID NO: 27642 - protein, 340 aa, Oryza sativa
MATTQLLSTVEHRETLPEGYARPESDRPRLAEVATDSNIPLIDLASPDKPRVIAEIAQACRTYGFFQVTNHGIAEELLEKVMAVALEFFRLPPEEKEKLYSDEPSKKIRLSTSFNVRKETVHNWRDYLRLHCHPLEEFVPEWPSNPAQFKEIMSTYCREVRQLGLRLLGAISVSLGLEEDYIEKVLGEQEQHMAVNYYPRCPEPDLTYGLPKHTDPNALTILLPDPHVAGLQVLRDGDQWIVVNPRPNALVVNLGDQIQALSNDAYKSVWHRAVVNAVQERMSVASFMCPCNSAVISPARKLVADGDAPVYRSFTYDEYYKKFWSRNLDQEHCLELFKGQ

SEQ ID NO: 27643 - protein, 259 aa, Candida albicans
MFNRSIRISRSPLLRSRTILPRTFVTNTHRLSYRLKQRNPSTIFKQSAMTLITISQSLDEAYTKHKVIPEVVDQFDTQGLLSIEYGPTELVTLGNTLSVEGTQEVPKIQLTLNSPTEDGKIESISENDKFILVMTDPDAPSNSDHKWSEYLHWLVTDLKLPHTKNEDGEPEISHFIDVKEGRELVPYMGPGPPPKTGKHRYVFLLYKQDPNAGELTAPKDRPNWGTGVPSSGVKDWIEKNAPNSKLLSVNFFFAQNEDN

SEQ ID NO: 27644 - protein, 475 aa, Robiginitalea biformata
MTRIRSILSEAPLLSEVSVSGWVRTFRSNRFIALNDGSTLENLQCVVDFENFDEATLRRINTGAALTVRGTLVESQGRGQKVEVQVSQLEIHGDADPESYPIQPKKHSMEFLREQAHLRIRTNTFAAVMRVRSALAFGVHEYFTRNGFYYFHAPIITGSDAEGAGEMFRVSTLDPLTPPRDESGNVDFGEDFFGKETNLTVSGQLEAEAYAMALGKVYTFGPTFRAENSNTSRHLAEFWMIEPEMAFYDLDANMDLAEDFIQEVIRYVLKHCEEDLAFLDKRLEDEEKRKPQAERSGMGLIEKLRFVTDQPFKRVTYTEAIEILRNSKPNKKKKFQYPIDAWGADLQSEHERYLVEKHFQCPVILFNYPAEIKAFYMRLNDDGKTVRAMDILFPGIGEIVGGSQREERLDVLQEKMQQLGIDEKELWWYLDLRRFGTAVHSGFGLGFERLVQFATGMGNIRDVIPFPRTPQNAEF

SEQ ID NO: 27645 - protein, 118 aa, Oryza sativa
MAQDLRSQEIKNPIDIAEYLFRRLQQVGVESIHGVPGDYNLVALDYIPKVGLKWVGNCNELNAGYAADGYARVKGISALVTTFGVGELSAVNAIAGAYSEYVPIVHIVGYPSTVSQKN

SEQ ID NO: 27646 - protein, 445 aa, Glycine max
HVQGMMNNCWFRVKTNVCRPHKGEIGIVFEHPTQPGNQSGGWMAKEKHLEKSSESNPTLKKSVSSPFMNTTSKTYTMSEVRRHNNADSAWIIVHGHVYDCTRFLKDHPGGTDSILINAGTDCTEEFEAIHSDKAKQMLEDYRIGELTTTCYNSDSSSSNPSVHGSSDTIPLTPIKEVITPMRSVALNPREKIPCKLISKTSISHDVRLFRFALPSDDLLMGLPVGKHIFLCATVDEKLCMRAYTPTSSVHEVGYFDLVVKVYFKGVHPKFPNGGIMSQHLDSLPIGSVLDVKGPLGHIEYTGRGNFLVHGKPRFATRLAMLAGGTGITPIYQVVQAILKDPEDCTEMHVVYANRTEDDILLKEELDEWAKKYDRLKVWYVIQESIREGWEYSVGFITESILTEHIPNASPDTLALTCGPPPMIQFAVQPNLEKLGYDTQNNLLVF

SEQ ID NO: 27647 - protein, 206 aa, Neisseria meningitidis
MAVRSKSSKAWLHEHVNDHYVHMAQKDGYRARAAYKLLEINEKDKLIKPGTVLADLGSAPGSWSQVAAKLTGTSGAVFALDILPMEAIGGVSFIQGDFRENDVLAQFEGLLNNRPLDLVICDMAPNMSGNAVSDQARSFYLCELALDFASQHLKTGGSFLVKVFQGAGYQEYMAAMREFFGTVQTRKPEASRNRSSEIYLLGKNKR

SEQ ID NO: 27648 - protein, 325 aa, Bradyrhizobium japonicum
MDASSATRAAHQPGRGRIYDSIVEAFGDTPIVRLRRLPGMHGVNATILAKLEYFNPAASVKDRIGAAMIIAMEKAGIVKPDTVLIEPTSGNTGIALAFVAASRGYRLKLVMPESMSIERRKMLAFLGAELVLTPAAQGMKGAIAAAEELVKTTPNSVMPQQFKNLANPEVHRRTTAEEIWNDTDGNIDFFVAGVGTGGTITGVGQVLKPRKASLRVVAVEPEESPVLSGGQHTPHKIQGIGAGFVPDILDRSVIDEIVKINSTTAIETSRALARHEGIPGGISSGAAIAAALQIGQRPEAAGKTILAVVPSFSERYLSTALFEGI

SEQ ID NO: 27649 - protein, 480 aa, Chlamydia trachomatis
MAPNTDIGLIGLAVMGKNLVLNMVDHGFSVSVYNRSPAKTEEFLKDHGESGALQGFTTIQEFVQSLKRPRKIMIMIKAGAPVDEMIASLLPFLEEGDILIDGGNSYYLDSEQRYVDLKKEGILFVGMGVSGGEEGARKGPSIMPGGNIDAWPAIAPIFQSIAAQVDGRPCCSWIGTGGAGHFVKAVHNGIEYGDIQLICETYEILKTRLNLSLEQIGNIFFEWNQTDLNSYLIGAAAAVLIAKDENGNAIASTILDVAGQKGTGRWVAEDAIKAGVPMSLIIESVLARYLSTWKEVRTKAAQEFPGIPLLCQPPQEASAFIEDVREALYAAKIISYAQGFMLLKQVSQDKGWDLNLGELALIWRGGCIIQSAFLDKIHQGFENSPEAHSLILQDYFKKVLFDSETGFRRAVLHAIGSGVAIPCLSSALSFYDGYRTVDSSLFLVQGLRDYFGAHGYERRDCPRGEFYHTDWLETKKTFRV

SEQ ID NO: 27650 - protein, 206 aa, Aspergillus niger
MAGTRNYDFLIKLLLIGDSGVGKSCCLLRFSEDSFTPSFITTIGIDFKIRTIELDGKRVKLQIWDTAGQERFRTITTAYYRGAMGILLVYDVTDERSFQNIRTWFSNVEQHASEGVHKILIGNKCDWEEKRAVSTEQGQQLANELGIPFLEVSAKNNINIEKAFYDLASDIKKGMDTSKSEQVGSQGVSIDQQGSGLNGSAGGKCC

SEQ ID NO: 27651 - protein, 201 aa, Aspergillus niger
MNPEYDYLFKLLLIGDSGVGKSCLLLRFADDTYTESYISTIGVDFKIRTIELDGKTVKLQIWDTAGQERFRTITSSYYRGAHGICVVYDVTDMDSFNNVKQWLQEIDRYATEGVNKLLVGNKSDMEDKKVVEYTVAKEFADSLGIPFLETSAKNASNVEQAFLTMARQIKERMGTATVNNKPTVQVGQGQGVQSGSAGGCC

SEQ ID NO: 27652 - protein, 484 aa, Rhodospirillum rubrum
MVDILFVSPPTPSPEEHAGYNLNAPPLGIGYLAAILRENGFEVDAIDLAFSDKPVADLRQKLRESDPRVVGFYTTTVTYYGTERLLAAVRKDHPEAITWVGGPHVSYEYETALASSGFDVVFLFEAEHSVLEAAKVQLRGKGRLDDVAGIAFRRDGRTIKTTPRAREKSLDIFPYPARDLFPIKKYTRPGSIMSSRGCPVKCIFCIASTFEDAYRYRSPENVVGEMKLMYEQWGINDFYFVDNVFTTYRARAREICRLIREADLPIGWYCVSRVDYAEPELMQDLASAGCYRIELGVESGDPSVIGGMKKHISLAHVYRAADVILNLGMQPMFTFQVGHPHDTLDSIEATLRLAEEIREMGAGAYLSVTTPYPGAPMMIEREKYGIVLETTNWEDFRWSNPTYRTATLSRNDIRKAIYRGAVGMARTLAEGKFQDPPSAPWLRFGPNGNGMRLPPPPKSRSDDDTALFSVPDRKRTLPVLQVAR

SEQ ID NO: 27653 - protein, 194 aa, Bacillus licheniformis
MRKAERARKTNETDIKLSFHIDGEGKADIQTDVPFMTHMLDLFTKHGQFDLSIEAKGDVEIDDHHTTEDIGICLGQALLEALGDKQGIKRYGSSMVPMDEALAQVAIDLSNRPHLEFRAEFPSRKIGTFDTELVHEFLWKFALEARMNLHVIVHYGTNTHHMIEAIFKALGRALDEAALIDPRVKGIPSTKGML

SEQ ID NO: 27654 - protein, 184 aa, Manihot esculenta
MATSMLSTATVASINRASPAQASMVAPFTGLKSTSAFTATTKTSADITSLASNGGRVQCMQVWPTRGKKKFETLSYLPPLSREQLASEIDYLLRSGWIPCLEFELEHGFVYRAHGSLPGYYDGRYWTMWKLPMFGCTDSSQVLKELDELIKAHPDGFARIIGFDNVRQVQCISFIAYKPPGTDY

SEQ ID NO: 27655 - protein, 266 aa, Brassica rapa
MADRVKGPWSQEEDEQLRLMVEKYGPRNWSAISKSIPGRSGKSCRLRWCNQLSPEVEHRPFSPEEDETIVSARAKFGNKWATIARLLNGRTDNAVKNHWNSTLKRKCSDGNPTAEEEQDPAKKRRSMSSESVPPVDTGLYMSPESPADVGSDSSAVPPQLFKPMTSSAEEDPATTLSLSLSVPVSQESRNTGSSDNSLPFPRFERQMKINVEERGGEARRAEFMTVVHEMVKAEVRSYMAEMQRNNAGGFVVGGFYDSGGITPKVE

SEQ ID NO: 27656 - protein, 495 aa, Mycobacterium avium
MVTDRFDAIIVGAGFGGIGAAIQLKRLGFDNIVILDREDDLGGTWHVNHYPGIAVDIPSTTYSYWFEPNPGWSRLFAPGGEVKQYAADVADKYDVRRHMRFNTTVEGAQWDEDAEVWRVALAGGESLTTRFLITATGFLSQPHTPDIPGIGSFGGKVVHTTAWDHDYRYQGRRIAVIGTGASAVQVVPELAKEAEELTVYQRTATHVLPKVDFEFDPAVRRLFARVPAAQRALRWVTDVLLEIIMIVGALHFKESRGRGNISASDLAKINRFRWIRDKELRAKLTPDYDCGCKRPTFSNSFYRVLTQPNVHLETNPIERIEPDGIVTADGRKNVIDTLVLATGFDLWEANFPAIEVIGRKGRNLGKWWRETRFQAYQGVSMPYFPNYLSLASPFAFSGLSFFHTIEYQMRHMDRLLGEVKRRGATTFEVTEEANDRFMERMTKLLDNSVFYAGNCATSRSYYFSPSGEASLLRPTSTLNSIREASSFPLSDYVIA

SEQ ID NO: 27657 - protein, 258 aa, Vibrio fischeri
MPSIQAQSEQKKQNGLVSLVGAGPGDPELLTMKGYRLIKEADVLVYDRLVSKEILALANENAEMIYVGKKLDFHFVPQDKINQILVDKAKEGKHVVRLKGGDSFIFGRGGEELETLAENGVHFEVIPGITAAAGATSYAGIPLTHRDHAQSVQFITAHVQKDGADIEWDALVRSNNTLVFYMGLKQSPHISEQLIKHGLAADTPCAIIERGTTNKQKVFTGDISELAQLAEKAISPSLIVVGTVTTLHHKLDWFKPNE

SEQ ID NO: 27658 - protein, 152 aa, Unknown
  Bradyrhizobium sp. BTAi1
MADAGTSETGALAAGPVVTPYERIGGAVVVDRLVESFYHRMDTLPEAKQVRDMHGTNLGPIKVILKRYLSEWLGGPKLYSPEKGHPRLRQRHLGFPIGNAERDAWLVCMRGALEETVADVQARQDVDAAMTKLADWMRNQAGNPHDARAARP

SEQ ID NO: 27659 - protein, 858 aa, Vibrio fischeri
MSKMKLVIIGNGMVGHRYIEDLVDKTDVQNMDITVFCEEPRIAYDRVHLSSYFSHHTADELSLVKEGFYEKHGINVLLGERAINVNRENRIVYSSTGREIQYDKLILATGSYPFVPPIKGNESKDCFVYRTIEDLKSIEATAKKSKSGVVIGGGLLGLEAAGALKALGVTTHVVEFAPVLMAEQLDQQGGLQLRNKIERMGVQVHTSKNTLEIAPEGTDARNVMRFADGSELETDFIVFSAGIRPQDKLARQMGLGIAPRGGIEINNNCQTTDKNIYAIGECASWNQTFYGLVAPGYKMATVAVDHLVGNESEFEGADMSAKLKLLGVKVGSIGDANGRTPGCKSYVYQNEEEEIYKRIIVSEDGKKLLGAVMVGDTSDYGDLLQLKLNDIDLPEHPDLLILPAHAGAEKPSLGADSLPESAVICSCFDVTKGKIAQAVADGNHTMAEIKAVTGAGTGCGGCIPLVTSVLNAELAKSGIEVKNDICEHFAYSRQELFHLIRIEEIKTFDELLEKYGKGYGCEVCKPAVGSILASCWGEHILKPELVKLHDTNDNFLGNMQKDGTYSVIPRMAGGEVTPQALSVLADVAAEYNLYTKITGAQRIGLFGAQKDDLPAIWKKLIAAGYETGQAYAKALRMAKTCVGSTWCRYGVQDSVGLGVMIENRYKGIRTPHKMKFGVSGCTRECAEAQGKDLGIIATDAGWNMYVCGNGGMKPRHADLLATDLDQETLIKYIDRFMMFYIRTAAPLQRTSVWMENLEGGVDYLREVIVDNKLGINDQLELDVAKLVNEFSCEWTDAINDESQLKRFTHFINSDERDDNVVFVSDGREQHRPATYTEKNPNAKGDILHVALTDATVEK

SEQ ID NO: 27660 - protein, 264 aa, Corynebacterium efficiens
MNSPDSASATPAGEVPGTVHSVTLIGGGPGAWDLITVRGMNRLREADVILADHLGPTSELDKLCDLSTKEVVDVSKLPYGRQVAQSRTNELLVEYALAGRRVVRLKGGDPYVFGRGFEELEYLARHGIACEVIPGVTSAISVPGAAGVPITQRGIVHCFTVISGHLPPGHPDSLLDWDALARTGGTLSIIMGVKNAGRIADALMQGGLSPHTPVAIIQEGTTQAQRSVRCTLDSLGEVMIREEIQPPAVYVVGEVAGLGQPEVP

SEQ ID NO: 27661 - protein, 113 aa, Glycine max
  misc_feature (27)..(27): Xaa can be any naturally occurring amino acid
  misc_feature (60)..(60): Xaa can be any naturally occurring amino acid
RDVRNCGQDFIHELTCMITVSHIPGIXTSRTDGYNKTTEGNENGPIMCCRGVNDSMDYIXAPNGEVYNYSRCGNTFNCYHAVARQFIAGCLRYRVTKMHVDGCCFEPASIMTR

SEQ ID NO: 27662 - protein, 307 aa, Bacillus cereus
MNVYRGVHELIGHTPIVEITRFSLPEGVRLFAKLEFYNPGGSVKDRLGRELIEDALEKGLVTEGGTIIEPTAGNTGIGLALAALQHDLHVIVCVPEKFSIEKQELMKALGATVVHTPTEQGMTGAIAKAKELVNEIPNSYSPSQFANEANPRAYFKTLGPELWDALNGEINIFVAGAGTGGTFMGTASYLKEKNIDIKTVIVEPEGSILNGGKAGSHETEGIGLEFIPPFLKTSYFDEIHTISDRNAFLRVKELAQKEGLLVGSSSGAAFHASLLEAEKAAPGTNIVTIFPDSSERYLSKDIYKGWE

SEQ ID NO: 27663 - protein, 339 aa, Yersinia pestis
MIHQFLGGHVTLQQKLTQFPRLDLVGNATPLEKLSRLSDYLGREIYIKRDDVTPVALGGNKLRKLEFLAADALRQGADTLVTAGAIQSNHVRQTAAVAAKLGLHCVALLENPIGTEQANYLTNGNRLLLDLFNVDVVMCEALNDPNQQLAELATRVEAQGFRPYVVPIGGSNALGALGYVQCSLEIAAQAAGNVAFSSVVVASGSAGTHAGLAVGLQQLLPDAELIGVTVSRSADEQRPKVAQIQQALATSLGMTDPLAKITLWDSYFAPQYGMPNEEGIAAIKLLARLEGILLDPVYTGKAMAGLLDGIEQQKFCDKGPILFIHTGGAPALFAYHPQV

SEQ ID NO: 27664 - protein, 206 aa, Cucumis sativus
PFSGEPPSYLTGEFPGDYGWDTAGLSADPETFAKNRELEVIHSTWAMLGALGCVFPELLSRNGVKFGEAVWFKAGSQIFSEGGLDYLGNPSLVHAQSILAIWACQVVLMGAVEGYRIAGGPLGEVTDPIYPGGSFDPLGLADDPEAFAELKVKELKNGRLAMFSMFGFFVQAIVTGKGPLENLADHLADPVNNNAWAYATNFVPGK

SEQ ID NO: 27665 - protein, 489 aa, Zea mays
SRPRSTGPSRRSRPRSTSRRRPRTPRAPNPRRRRTLPPRRPPSRRHPHTLPPLRPTNPLPLLRRTPLPPNLRHLSRPRRRTLQAPSHRLASLPRPSRPRRRTPLLPSLDAQSMEIISRWIPGWGIDAVTLPLAVDLNIATDSATKAARTLARDEDFKFRAAHWGDLHRRLHEELPPAVTVLWGHQFLSFEAPDDTRGVVATARVLRTGGTVEATGDLLIAADGSTSSVRRSFLPDLKLRYSGYCAWRGVFDFSGKESSDTMTSIRRAYPELGNCLYFDLAYKTHAVLYELPRSRLNWLWYINGPEPELAGNSVTMEATDAMVGRMRNEAERVWCPELARLVRETAAPFVNVIYDADPLRRLSWTGGRVVLVGDAAHPTTPHGLRSTNMSVMDACTLGQCLANWNSEPTPARALAEYEAVRLPVVAEQVLHARQLGRLKQGLPVDGEAEDGFDVTTAKAEVLQLRQRTMPFFDGAPAAVGGDFPLVGSTR

SEQ ID NO: 27666 - protein, 1115 aa, Pseudomonas fluorescens
MAKKPRPTTFIKDPLWYKDAVIYQVHVKSYFDSNNDGIGDFPGLIAKLDYIKDLGVNTIWLLPFYPSPRRDDGYDIAEYRGVSPDYGTLADARRFIAEAHKRELRVITELVINHTSDQHPWFQRARKAKPGSAARNFYVWSDDDQKYDGTRIIFLDTEKSNWTWDPVAGQYFWHRFYSHQPDLNFDNPQVMKAVLSVMRYWLDMGIDGLRLDAIPYLIERDGTNNENLPETHQVLKQIRAEIDANYPDRMLLAEANQWPEDTQLYFGDVTGSDGDECHMAFHFPLMPRMYMALAQEDRFPITDILRQTPEIPANCQWAIFLRNHDELTLEMVTDRERDYLWNYYAADRRARINLGIRRRLAPLMERDRRRIELLNSLLLSMPGTPTLYYGDEIGMGDNIYLGDRDGVRTPMQWSIDRNGGFSRADPASLVLPPIMDSLYGYPSVNVETQSGDPHSLLNWTRRMLAVRKQSKAFGRGTLKMLSPSNRRILAYTREYTGPDGKQEIILCVANVSRSAQAAELDLSAFAGMVPVEMLGGNAFPPIGQLNFLLTLAPYGFYWFVLAAENQMPSWHVEPAQSLPDFTTLVLKKRLEELLEAPSRTTLEQEVLPNWLPKRRWFAGKDSAIDQARIAYGVRFGDPQHPVLLSEIEVTSAGRSERYQLPFGLLAEEQINSALPQQLAMARVRRGRQVGLITDAFALDSFVRNVLLALQGTTCLDSEQGQIRFEATAQLAALGLGADAEVRYLSAEQSNSSVVVGGSLVLKLIRKVAGGIHPELEMGAFLTAAGFAHISPLLGSVLRRDAQGEDHLLMIAQGYLNNQGDAWEWTQNNLERAIRDELAEAMSEQEQHYNALGELQDFAGLLGQRLGEMHLLLAAPSDNPDFAPEHATAKDAQAWNQQVAEQLERGLQLLQQHQAELAAGEQKLLGKLLQHKALILGHIQQLAKQLVGGVRIRVHGDLHLGQVLVIKGDAYLIDFEGEPARPLAERRGKHSPYKDVSGVLRSFDYAAAMALEAPAVDGAQGAAAGRRKVVTRYLAEARHAFVQAYRLATANLAHGWQDPAAADAALALFSLEKAAYELAYEAENRPAWLPVPLHGLVGLLRELKPFSDIESGGEQS

SEQ ID NO: 27667 - protein, 267 aa, Petunia sp.
MAAATMALSSSTFAGKVVKLSPSSSEITGNGKATMRKTATKAKPVSSGSPWYGPDRVKYLGPFSGEAPSYLTGEFPGDYGWDTAGLSADPETFAKNRELEVIHCRWAMLGALGCVFPELFARNGVKFGEAVWLKAGSQIFSEGGLDYLGNPSLVHAQSILAIWACQVLLMGAVEGYRVAGGPLGVVVDPLYPGGSFDPLGLAEDPEAFAELKVKETKNGRLAMFSMFGFFIQAIVTGKGPLENLADHLVDPVNNNAWSYATNFVPRK

SEQ ID NO: 27668 - protein, 278 aa, Arabidopsis thaliana
MGRQPCCDKVGLKKGPWTAEEDRKLINFILTNGQCCWRAVPKLSGLLRCGKSCRLRWTNYLRPDLKRGLLSDYEEKMVIDLHSQLGNRWSKIASHLPGRTDNEIKNHWNTHIKTKLRKMGIDLLTHKPLSIVEKEDEEPLKKLQNNTVPFQETMERPLENNIKNISRLEESLGDDQFMEINLEYGVEDVPLIETESLDLICSNSTMSSSTSTSSHSSNDSSFLKDLQFPEFEWSDYGSSNNDNNNGVDNIIENNMMSLWEISDFSSLDLLLNDESSST

SEQ ID NO: 27669 - protein, 1342 aa, Yersinia pseudotuberculosis
MHTPIIWCNSLRTTFLLRARFLLRARFSLRSWFFLRTVLCCLLLISGQLHASLMTGRQGCDTGQPLTIHSIANSYNDDLLLTPATDTRQSSRRTVKVGVVMDANTPFVVNRDDNAIEGIVADYLKIISDASQLSFQMIGYCDYGLVLNALENGQIDLMAGTPMLAQPGLIASHAFFTNRHVEVRSKNWDPTKRTHPETVAIVNNEPLSPEFLFNYHADRIVAYPNQLQGLLAVAYGNADVFVANATSANYLIDQLQLLTLQIRNFAPYHPAPYSFLARESNQKLIDYLNQILELLPTRATGDIQQRWFGSKHHYNIDAKLLLTEQEISWIQHHPVVTYIAPLDLAPLIFRDRRTGEMAGFSVDLIDIIARRTGIKFDPVYTKDTGEGVRSFKAGKVDLLPIVAVRNGQYGNNLYSSSIAQSLWGIMTREDRMDINNVGDLAGKRVGIQAGSASSSIIGNPLLAQRITFVEAPDTMTLVRWLQQGKVDAVVKNMMTANYLSAQNFSPNIKTVAVAGEEPLMMAFAIRPDLPELKTIIDKVIESIPPEEFDNLTSEWSTFKPKPISFDESSLDNELLMIALKISSGLLLVFGLYLCYLVFNKRRQAKLLHARLLQQESIINALPFAVFIRTASGELAVYNSHFADVHSDKLYDMLNQTHEPAHWPMTSPLDREIDKYCRSVLLNRKPQLVDLSVEIKGEIRDIFLWIIPLNNAEQGLLGGWLDISQRKTVERQLEAARVEAESANRTKSTFLATISHELRTPMYAIMGLLELEIRSNRPVEKDTLVTVSKSAQSLMLLLDDIIDSAKIEAGQLSIHPTAVDFHQEMERMFTLYQPIANERGLRFSGWLDDHIPPLLMADMLRVRQVMGNLLGNALKFTEQGSVSVDITWEPSDEQHGVMNIDITDTGIGISPAAQATLFQPFSQANEGKSPRFGGSGLGLWICHQLIHKMGGKIALESQLGKGTSLLITLPLNIATADDLAQDAAITHVDDERLNQLRNLRILVVDDLPANRQLLQQQLAFIGIEQVVTAENGAKACQILQHNNFDVVITDCSMPVMDGYELAAHIRQDPALKDLIVIGCTADAREESAARCIDAGMNACMIKPVAIDTLQATLLRKDIVSQIANTNHSHSTEDNDRGGNQHNLSEKDTAQQENAPAIHSTTITSSVNRLAAAQNKLRTLSGGNPAVELQLLQSLLESNLQDAVTLTQLYRQLCVEDEDVVETVDTAETVDTAETADTVEDGETRGPGSTVGRHSTTGSDHIPHADIYKQMASLVHRIKGSVQLIDAQELVASCVKFESQLHAQNKQAAMTHGADCLALFIESNQLLVTLISQYPKAATEDSPQ

SEQ ID NO: 27670 - protein, 135 aa, Leifsonia xyli
MTGIPVGPPAGPTFFEQAGGHDTFRRLVDAFYRGVAADPVLRPMYPEEDLEPAAERLTLFLEQYWGGPAAYSEQRGHPRLRMRHLPFRVNPDARDRWLMNMRAAVLELALPPLQEETLWSYLERAAFAMVNTFEE

SEQ ID NO: 27671 - protein, 719 aa, Pseudomonas fluorescens
MSRSKQPAATPESEPSRIREGLPFPLGATWDGLGVNFALFSANATKVELCVFDDAGEVELERIELPEYTDEIFHGYLPDAHPGLIYGYRVHGPYDPANGHRFNPNKLLIDPYAKQLVGELKWSEALFGYTIGHPDADLSFDERDSAPFVPKCKVIDPAHTWGNDQRVSVPWDKTIIYETHVRGFTMRHPSVPENLRGSFAGLMVDDVLEHIRKLGVSSVELLPIHAFVNDQHLLHKGMTNYWGYNSIAFFAPDPRYLASGKIAEFKEMVAHLHEAGLEVILDVVYNHTAEGNEQGPTLSMRGIDNASYYRLMPDDKRFYINDSGTGNTLDLSHPCVLQMVTDSLRYWATEMHVDGFRFDLATILGRYHDGFDERHSFLVACRQDPVLRQVKMIAEPWDCGPGGYQVGNFPPGWVEWNDRFRDTVRAFWKGDDGQLADFAGRMTASGEMFNQRGRRPYASVNFVTAHDGFTLHDLVSYNDKHNEANDENNQDGSNNNLSWNHGVEGPSDDPEINALRLRQMRNFFATLLLAQGTPMVVAGDEFARTQHGNNNAYCQDSEIGWVNWELDNDGKSLLKFVKRLIKLRLSYPILRRGRFLVGSYNEDIGVKDVTWLAPDGSEMTTEHWQDPHGRCLGMLLDGRAQETGIRRPGADATLLLVVNAHHDIVNFRLPEVPAGEFWTCMLDTNQPAVRGQERFAFGHEYSVTGRSLLLFELQHEEED

SEQ ID NO: 27672 - protein, 404 aa, Methanothermobacter thermautotrophicus
MKARAEKIADGLYWTGVLDWDIRNYHGYTLQGTTYNAYLVFGDEGVALIDNSYPGTFQELMARMEDAFNREGREMRVDFIVQNHVERDHSGVLVELHRRFPEAEIHCTEVAVEGLLKHYPALEGTEFRTVKTGDSIDLGGRTLTFLEAPLLHWPDSMFTFLDTGILFSNDAFGQHLCYPQRLDTEIPEYILMDAAKKFYANLITPLSKLVLRKFDEVKELGLLDKIGMIAPSHGQIWTEPMKIIEAYTAWATGKVKKKVTVIYDTMHHSTAMMAHAIAEGAMSEGADVRVYYLHEDDRSEIVKDILDSHAIALGAPAIYDEPYPSVGDLLMYLRGLKFNRTGQRRAMVFGSMGGRGGATGTMQKLLADAGFDVMEADEIYYVPNNEELDACFEAGRRLAGDLNE

SEQ ID NO: 27673 - protein, 510 aa, Aspergillus oryzae
MAQEHHLDALVVGAGFGGIYTLYSLVKEGLNVKAIDTAGDVGGTWYWNRYPGALSDTWSHLYRFLFDQEFLQTYPWKRWYLTQPEIMQYLRDVVERYHLRKHMQFNTKMQRAEWNDETKIWEVQCETGDVFHVRYLFTALGLLVKANYPDIPGMDTFKGEMNHTSAWNPDVELENKRVGVIGVGSSGVQVVTAIADKVKSLHVFVRRPQYTVPSGNRDVTPKERALVNKNYPALIADARTSVFAMGTPEPKRTFMSLSPEDREELLEQQWNIGNGFQFMFGGFSDIATNEVANEEVCRFLRKKIASIVKDPQKRDVLTPKELYGRRPLCDAGFYEIFNKENVFAVDIKKSPITEVTPSGICTADGTTHELDVIIFATGFDAVDGTYAMVDIRGRDGKNLYDMWKPSGPSTYVGMSVHGFPNLLLVNGPHMAFANIPTSGETNTEFIMDLVRRAEKISKQTGRQCEIEALEEAERAWTARSRSSIAGTMLAPCFPSDLVLALNLLQSCPVQ

SEQ ID NO: 27674 - protein, 394 aa, Guillardia theta
MLNSIKLILIKLIHEKSESIENLFESIYEFSNYKKPQEWNLFQDQIKTQNENALQVAQCTKIFKNKKDQVNCIVYVKHSGKFVVNIGEKLSPTDIEEGMRVGIDRSKYQIQITLPLKIDPNVTMMTVEEKPEITYKEIGGCKNQILEIKEIVEYPLLYPRRFSLMGIDPPKGALLYGPPGTGKTLVARAVANKTNASFVKINCSELVQKYIGEGARLVRELFNLSKTKFACIMFFDELDAIGGTRFSGASGGENEVQRTMLEIVNQLDGFEKRGNTKVLMATNRPDTIDPALLRPGRLDRKIEFSLPDLSGRVTILKIHSKKMKKEESIRYELIARLCPNSTGADIRSICIEAGMFAIRKRHKIVYEEDFLDSINKVLKNNLKFSYTSRYIKYN

SEQ ID NO: 27675 - protein, 404 aa, Methanothermobacter marburgensis
MKAAAKRISDGVYWTGVLDWDLRNYHGYTLQGTTYNAYLVCGDEGVALIDNSYPGTFDELMARVEDALQQVGMERVDYIIQNHVEKDHSGVLVELHRRFPEAPIYCTEVAVKGLLKHYPSLREAEFMTVKTGDVLDLGGKTLTFLETPLLHWPDSMFTLLDEDGILFSNDAFGQHLCCPQRLDREIPEYILMDAARKFYANLITPLSKLVLKKFDEVKELGLLERIQMIAPSHGQIWTDPMKIIEAYTGWATGMVDERVTVIYDTMHGSTRKMAHAIAEGAMSEGVDVRVYCLHEDDRSEIVKDILESGAIALGAPTIYDEPYPSVGDLLMYLRGLKFNRTLTRKALVFGSMGGNGGATGTMKELLAEAGFDVACEEEVYYVPTGDELDACFEAGRKLAAEIRR

SEQ ID NO: 27676 - protein, 675 aa, Gibberella zeae
MSAARNPTNWDDYDGGGSPGESVTESMLEREQALVDDDDNNNDGGNQEGLRRRRRSSITYQLAAIADIGGVNSFRSFARSWQRAAGFHEVIPRRPSFVLAPEGEAQDLEYSRSHVQGSQPQSGLLRQHLEASSSQANGESSSAIDSSPRPMRMSRRDDETKPLLDVEAGDSSIVGSPRSSIFAVPPHLAAPDIVGSYGSFRDSSPFGTMDRSTRHRISFSEGSGWGVADEDEVEGEDAAHGEHQPILVKEVKQGNKVVLAVEGQSTLPQSVFNSINALIGVGLLSLPLAFQMTGWITGLFLLTFTAVVTSYTGKLLAKCMNFDPSLITYSDLAYVSFGTRARVIVSALFSLELIAACVALVILFADSLSLLLPGLATVNTWKVVASCLVLVLNALPLRLLSYTSVVGIFSTFCIVVIVIIDGLYKPNYPGSLREPATTYLLPENWLAVPLAYGLLASPWGAHSVFPSIYRDMRHPYKWGKAVNITFSFSYLVDTCLAVIGMLMFGDGIKDAITSNILKSKGYPDALKIIMCIFIAIIPLTKIPLNARPIITTLDVICGVHEQHHHHHDTPHSQPTRSSVLITKAVRMLVRVFVVILLLFISIVFPAFDSVCAFLGAALCTLISIILPISFYLKLYWQDVTFQEKTVSFILLVVFSILGTLGTIWTFLPKHLIGAD

SEQ ID NO: 27677 - protein, 598 aa, Unknown
  Azoarcus sp. BH72
MLEQFSGILRRSPNPDPSAASGTALERVDLGRATVAYRPAIAVARDGTGLCIALGRPRFADPALQAIAAQQGPAVAWLQALRDQGESVIPSVRGRFNVVFIERDGAEALFATDRFGTWPLCYAEQDGALHFADRADALPGPGRRLSAQAVYEYLFFHMIPAPTTIFEGVARLPGGHVLQWKDGRATCRAWWQPRFDERERPSFESAKRQFLDIVENAVRRDAEGPVGCFLSGGTDSSTVTGMLCKVLGRPARSYSIGFDASGYDEMEYARIAARHFGADHHEYYVTPDDLLDGIPRVAVHYDQPFGNSSAVPAWICASRAQDEGVARLLAGDGGDELFGGNTRYAKQRVFGWYDSVPGLVRRGMLEPVLALPGMGRIPLMKKGVSYVEQARVPMPDRMHMYNMLLRLGTREVFEADFLARIDVDRPQQQQREVWQASSARSQVNRMLAYDWKYTLADNDLPKVIGTTQLAGVDVAFPLLSDELLDFSLTLPPDWKLRGLTLRWFFKEALRGFLPDQIITKKKHGFGLPFGVWACAHAGLKAQAHDALRSLAARGIVRPRFIDELFTTHLPAHPGYYGEMVWILMMLEFWLRAHDGSTL

SEQ ID NO: 27678 - protein, 715 aa, Yersinia pestis
MKKILTVCPYCGSGCKLNLLVEDGEIVGAEPADGVTNQGALCLKGYYGWDFLNDTRLLTPRLTTPLLRRQRGEAFQPVSWEAAIAFITAKLSAIKERHGPDAIMMTGSSRGPGNEANYVMQKFARAAIGTNNIDCCARLCHGPSVAGLQQTLGNGAMSNSIGEIENTDCILVFGYNAADSHPIVARRILKAKNKGAKLIVCDPRHIETARIADQWLPLKNGANMALVNAFIHVLIEEKLYDANYVRDHTRGFDELKAGVAAYRPEDVEPITGLSAKAVRQAMRTYAAAPAATLLWGMGVTQWGQAVDVVKGLSSLALLTGNLGRPNVGVGPVRGQNNVQGACDMGVLPNTFPGYEKVTDSEARARFAHAWGVAELPAHVGYSITDVPHKVAEGKLKAYYVFGEDPIQTEPDLAAMRAAFAALDLVVVQDIFMTKTAELADVVLPATSWGEHEGVYTSADRGFQHFNKAIEPKGDVKPDWEIISLISTAMGYPMAYQNTQQIWDEMRGLCPPFAGVTYEKLAGLGYVQWPCPTEDHPGTPYLYTDNQFATADGKGLLSCAPWQPPHEQTDSDYPLALCTVREVGHYSCRSMTGNCGTLKILADEPGYVQIHPEDASYLGVIDQALIWISSRRGKVIARASVTERANRGAVYMTYQWWIGACNELTVDHVDPVSKTPEFKHCAVKVEAISDQTAAEQYVEQQYSQLKKRLSDAAVVP

SEQ ID NO: 27679 - protein, 460 aa, Bacillus clausii
MNVLEKEKGTYTSDVHEYVQHVYETVKQRNPYENEFHQAVKEVLDSLLPVLAKRPQYIRQAILERIVEPERMISFRVPWVDDQGNVQVNRGFRVQFNSALGPYKGGLRFHPSVNTSIIKFLGFEQIFKNALTGQPIGGGKGGSDFDPKGKSDGEIMRFTQSFMSELSKYIGPDTDVPAGDIGVGAKEIGYMFGQYKKMRGRFEAGVLTGKDIAYGGSLARKEATGYGTVYFVEEMLKEKGHSFAGSTVVVSGSGNVSIYAMEKAMHLGAKVVACSDSEGYIYDKRGINLETVKRLKESEKKRISEYVNEHPQAHFFQGCSDIWSVPCDIALPCATQNEIDENTATVLVSNGVKAIGEGANMPSTLEAVNVFHEHGVLFAPAKAANAGGVSVSALEMAQNSARLSWTFEEVDAKLQDIMKTIYRDCIEAAKENDAPGNLVVGANIAGFVKVADAMIAQGVI

SEQ ID NO: 27680 - protein, 160 aa, Unknown
  uncultured archaeon GZfos19C8
MYRYREGGMMMEEKRDLSGFVNAEEAEIEQIKERKMREMEEKIKAKGEEQKEGIIDYPIVLTDETFTDAVRKSSLIVVDCWAPWCGPCKTIAPVIEELAKQYAGKVVFGKLNVDENPKVATDFAIMAIPTMFIFKNGEPVDVIQGALPKPYLEAKLKEWL

SEQ ID NO: 27681 - protein, 180 aa, Ralstonia metallidurans
MMTAEQARELWLDSEEIVSAEEVQNSLDRMAHDITEKMGDAFPLVLSVMGGAVVFTGMLLPKLQFPLEFDYIHLSRYNNKTVGGEMQWRVAPRESVKGRVVLVLDDILDEGETMAAIRQRIMDMGAKECHAAVLCEKTLTKIKPMHPDFCGFQVPDRYVFGCGMDVKGYWRNLGAIRALV

SEQ ID NO: 27682 - protein, 211 aa, Oryza sativa
MSSPATAAAAAASCGVLRHHHPPASPRPPPTTTTTSRLLLASRSRGLQRPLRVNHAPPRRLPPTAARAQSAAAAGYQPESEFYKVEAILRPWRVPYVSSGLLQMGIRGVTVSDVRGFGAQGGSTERHEGSEFAEDTFIDKVKMEIVVSKDQVEAVVDKIIEKARTGEIGDGKIFLIPVSDVIRIRTGERGERAERMAGGLADKLSSAMPIS

SEQ ID NO: 27683 - protein, 266 aa, Haloarcula marismortui
MKYSGWPEPGELVVGKIDEIEDFGVFVDLDEYEGKRGLCHISEVASGWIKNVRDHVNEGQTVVAKVLDVDESAQQIDLSIKDVNDHQRKEKIQEWKNEQKADNWMELAFGEDLDDETYAAIANELLAEFGSMYDGFESAAIHGKDALEDVDLSEEEIDAIVQTARNNVSVPYVQVTGYVDLSCPESDGVDIIKEALQAAEGNGEVPDEIELEVTYVGSPEYRIQVQAPDYKTAEDALEESADRAAKVVEQHGGSGQFHRERSEDDE

SEQ ID NO: 27684 - protein, 236 aa, Glycine max
SYNGLCVIFLLTVKVYVYSGPARCYRQIKNKPYPKSRFCRGVPEPKIRIYDVGMKKKGVDEFPFCVHLVSWEKENVSSEALEAARIACNKYMAKFAGKDAFHLRVRVHPFHVLRINKMLSCAGADRLQTGMRGAFGKPQGTCARVNIGQVLLSVRCKDANSHHAQEALRRAKFKFPGRQKIILSRKWGFTKFSRSEYLKLKSENRIVPDGVNAKVLGCHGPLANREPGRAFLPATA

SEQ ID NO: 27685 - protein, 231 aa, Nicotiana benthamiana
MAPKEKGTAAGKVNGVSKEVHYRGVRKRPWGRYAAEIRDPGKKSRVWLGTFDTAEDAARAYDAAAREFRGTKAKTNFLVLEQENVKLANGNRSPSYSSTVENSPPVMPENSPPAVILDTSPLDLSLGGSGSLFSNGVGRFHMYYLEAVQREQVISSYKKSCRTTAEFIAGCGGGASGESDCRTTAEFIAGCGGGASGESDSSSVIDFMGHDLKPTTRPINLDLNLPPPENM

SEQ ID NO: 27686 - protein, 281 aa, Salinibacter ruber
MPVRAAYLQFAPAYLEVDQNLAAVESLLRSVEADLIVLPELFTSGYFFQSKDDLERVAEPIPNGKSVAALRGWADSLGATLVAGLAERDGDHFYNSAVVVRPDGRVDTYRKVHLFYEETILFEAGDLGFRVFEEHTAAGTSYRLGVMVCFDWYFPEAARTLALRGADVIAHPSNLVLPHCPDSMPVRARENHVFTITANRHGREEKEGESLRFIGMSEVCAPSGTILTRADESADVVEVVELNPREARDRNINAHNDVLRDRRPATYAATSEEGTALESGS

SEQ ID NO: 27687 - protein, 196 aa, Unknown
  Candidatus Pelagibacter ubique HTCC1002
MSRIGKVSRKTKETSISVEVNIDGKGQYKIDTGIGFLDHMLEQLSKHSLIDLKVKAKGDTHIDLHHTTEDTGIAIGEALKKALKDFKGIKRYAHAMIPMDETLTRVAIDVSNRPYLIWKVKLKVERLGEMDTELFKEWFQAFSQSAGITLHMENIYGDNSHHIIESCYKALARSLRIALEIDPRNKKSIPSTKGSL

SEQ ID NO: 27688 - protein, 308 aa, Xanthomonas oryzae
MARYLRALLMLDAAMTRHLLSVALIQERNHGDAEANLAVIASRVAEAAAQGAKLVLLQELHNGAYFCQHESVDEFDLAEPIPGPSTERLGALAKQHGVVLVASLFERRAAGLYHNTAVVFEKDGRLLDKYRKMHIPDDPGFYEKFYFTPGDLGFTPIDTSVGRLGVLVCWDQWYPEAARLMALAGAELLLYPTAIGWDPDDQQPEQERQRDAWVLSHRGHAVANGVPVLSCNRVGHEPSPLGASGIQFWGNSHVLGPQGEFIAEAGQDPTVLICDVDLQRSEHVRRIWPFLRDRRIDAYGDLLKRYID

SEQ ID NO: 27689 - protein, 712 aa, Clostridium acetobutylicum
MVKKRLKSLIAVFITTAMMGGFMNLTDGKVMADETNTNFNYGEALQKSLMFYEFERSGKLPQDKRDNWRGDSGLDDGKDVGLDLTGGWYDAGDHVKFNLPASYTLTMLGWSLYQNRDSYEKSGQLKYLTSDMKWCSDFLMKCHPAPDVFYYQVGDSGLDHKWWGPAEVMQMDRPSFKVDDDNPGSAVTAEASAALAATALNFKNDDADYANKCLSHAKDLFNFADKTRSDKGYTAANGYYSSTSFYDDLSWAACWLYMATNDKSYLDKAEAYVDNWSREQQTDIISYKWGMCWDDVHYGAQVLLAELTNKQIYKDSVERNLDYWTVGYDGNKVQYTPKGLAWISSWGPLRYSLATAFLADTYSKWSGCDASKAKAYEDFAKSQVDYALGSSGRSYVVGFGVNPPEHPHHRTAESSWFDDKTVPGYSRHTLYGAMVGGPDQNDKFDDDVANFNQNEPACDYNAGLVATLSSMYGKYGGKPIDNFNAIEKPTNDEFYVEAAVNATGKNFEEIKSKIYNKTGWPARVTDKLSFKYFIDISEFVKQGYKASDIKVTTNYNEGGTASQLIPWDEKNNIYYVNVDFTGTKIYPGGQSAYKKEIQFRMTAPDNATWDNSNDFSYTGVEETPGDTPTLDKNIPVYDAGVKVYGNEPKGNVVVGDINGDGEVNGRDLMELRKYIAGKTTDINKDSADINGDGVINGRDLMELIRKISSVNP

SEQ ID NO: 27690 - protein, 268 aa, Hordeum vulgare
MASTIMAAASRAVVAKTPFLSGQGRAASASPLRDIAAATNGRITMGNDLWYGPDRVKYLGPFSAQTPSYLNGEFPGDYGWDTAGLSADPEAFARNRALEVIHGRWAMLGALGCVFPEVLQKWVGVEFKEPVWFKAGSQIFSEGGLDYLGNPNLVHAQSILAVLGFQVLLMGLVEGFRINGLDGVGEGNDLYPGGQYFDPLGLADDPVTFAELKVKEIKNGRLAMFSMFGFFVQAIVTGKGPLENLFDHLDDPVANNAWVFATKFAPGS

SEQ ID NO: 27691 - protein, 313 aa, Haloarcula marismortui
MTGWTIEDMPPLRDRTVVVTGANSGLGLEGSKAFARRGATVVMACRSVERGESAAAEIREAVPNATLDVRECDLADLSNVASFADGLRADYDAVDILCNNAGVMAIPRSETADGFETQFGVNHLGHFALTGHLLDLLGAADGESRIVTQSSGAHEMGEIDFDDLQRERSYGKWSAYGQSKLANLLFAYELQRRLGNHGWDDVLSVACHPGYADTDLQFRGPREMGSTLRTAAMGVANAVFAQSAEQGALPMLYAATAEDVIGGEYVGPGGLFDMRGSPEFQQSNDASQDEETAEQLWAVSTDLTGVEYDFERT

SEQ ID NO: 27692 - protein, 267 aa, Nicotiana plumbaginifolia
MAASTMALSSSSFAGKAVKLSPSSSEITGNGKVTMRKTASKAKPVSSSSPWYGPNRVKYLGPFSGESPSYLTGEFPGDYGWDTAGLSADPETFAKNRELEVIHCRWAMLGALGCVFPELLARNGVKFGEAVWFKGGSQIFSQGGLDYLGNPSLVHAQSILAIWACQVVLMGAVEGYRVAGEPLGEVVDPLYPGGSFDPLGLAEDPEAFAELKVKEIKNGRLAMFSMFGFFVQAIVTGKGPLENLADHLADPVNNNAWAYATNFVPGK

SEQ ID NO: 27693 - protein, 692 aa, Clostridium acetobutylicum
MKKLLATLVTVFMICMQITPVQAAKSTEDKNYNYVDAFSKSILFYEANWCGPDAGNNRLKWRGPCHEDDGKDVGLDLTGGFHDAGDHVKFGLPQAYAASTLGWAYYEFKDSFVKKGQDKYMLNILKHFTDYFLKCYPNKTTFYYQCGDGTTDHSYWGPPELQTLDITTRPTLYAATPDKPASDVCGSTAAALALMYINYKDVDAEYANKCLTAAKDLYDFGKTYKGLSESGGFYGSTGYLDDLSWGAVWLYAATNDNSYMTDIDSFLTAKGIGGDNSYSNHWTHCWDDVFGGVFVKLAQLTNNPKYKAIAEENLNYWIKDAPTTPGGLKYIASWGTLRYTAAECMLALVYYKTSKNEEYLNFAKSQIDYMLGSNPRNSSYEVGFGNNYPKNPHHRAASGRMEGAPGYEKKTDPEKHLLYGALVGGPDGTSDDYSDDVNQYVNSEVAIDYNAGFVGALAGMSNYYGGDNLPEDVPGIEANSPQYYVDANIMKESNEECTIQAFIHNASLLPPHYEKGMSFRYYVDLSELYKKGYTVNDVGVRANYAAGGGTLSGFIPYDEAKHIYYVEASWPGQLYGKAEMQFAITAYNAKCLDASNDFSRQNLKSDSTNISENIPVYKNGVKIFGNEPGSVEVKTGDVNGDNTVDGRDLMELRKYLAGNNPNINLKAADLNGDGIVNGRDLVILIKLISGKQ

SEQ ID NO: 27694 - protein, 485 aa, Unknown
  Oceanobacter sp. RED65
MNVVWFKRDLRLHDHDALFKAISLGKPCLLLYILEPSLIEDTHYDDRHWRFVYESLQDLNKQLSPYGHRLTVIKGEALDVLQAIHQRHEIHTIFSHQEIGIARTFSRDRKIEYWCKNNSIVWQQSPHGAVVRGLQHRLYWQDHWYNYMARSIPPIELNKLKSEQSCLHDVDAFDDIYKQTNPHFQYGGESSAMVTLEDFLTDRHLHYRGSISSPSRSRHYCSRLSPYLAWGNLSLRYCYQQTQLAFAQSKGKQHLNAFSSRLHWHCHFIQKFESESRMEFEAVNRGYLDFPYDIGDSAHEKLAIWQQGKTGYPLVDACIRCLQTTGYLNFRMRAMLVSFACHYLNLHWKSVAEYLAKLFLDFDPGIHYSQIQMQAGITGTNTIRIYNPVKQSQEQDPEGEFIRLWCPELSSLSNDVIHSPWLLGPLEKQMFALDYPEPMVNADCIQINRERLWSWRSRDKVKLEAKRILNTHVTPNSETRQQAKR

SEQ ID NO: 27695 - protein, 375 aa, Zea mays
MAAAAIHQFAECITCHAWSPDQSMIAFCPNNHEVHIYKFFTDKWEKLHVLSKHDQIVSGIDWSNSSNKIVTVSHDRNSYVWTQEGSDWIPTLVILKLNRAALCVQWSPKENKFAVGSGAKSVCICYYEQENNWWISKVIRKRHESSVTSLAWHPNNIYLATTSTDGKCRVFSTFIKGVDTRGSQSSTSTNSKFGEQIAQLDLSSTWVFGVRWSPSGKTLAYAGHNSMVYVIDEVESSPVAQNLTLRDLPLRDVLFVSERTLVGVGFDCNPMIFAADDTGLWSFVRFLDEMKAAPSASKASQLSEALGKLYGQSKQGASSDTVEPSKARGGAHENCITCIVPLRKGSDGTIKRFSTSGLDGKVVVWDLENHVSIAK

SEQ ID NO: 27696 - protein, 537 aa, Clostridium acetobutylicum
MKKLVACLTMVLLLGTQIKPLTITADTNDQKHNYVDAFSKSIMFYEANWCGADAGNNRLKWRSGCHENDGKDVGLDLTGGFHDAGDHVKFGLPQAYSASTLGWAYYEFKDTFVKKGQDKYMLNILKHFTDYFLKCYPDNNTFYYQCGDGNTDHSYWGPPELQTTSRPTLYKATPSTPASDVCGNTAAALALMYINYKDVDSAYANKCLTAAENLYNLGKNYKGMSQSGGFYTSSGYLDDLSWGAIWLYEATNNNNYLSDAQSFLQSANINEYYQYNWTHCWDDVLGGVFVKMAQITGDAKYKNIVKGNIDYWTNSVTTTPGGLKFRTGWGTLRYTAAECMLALVYYKTSNDSEAMNLAKSQIDYILGTNPQGMSYEVGFGSKYPKYPHHRAASGRNESAGEKKTEPEKHILYGALVGGPDQNDSYIENIEEYQHSEVAIDYNAGFVGALAGISNYFGQNQSVEKINDPDVKDSNTTNTILGDLNDDGVVNGRDIVMMRQYLAGKTVSGIDKNALDINGDGAVNGRDLMELIKKVSNN

SEQ ID NO: 27697 - protein, 429 aa, Picrophilus torridus
MDYDDVMLKTIGLKDKMDLFKDIPESLRIDIDLGPEIGEMELIKQFYEISKMNKKPEHFFLGNGIYRRYIPSLVDEIISRYEFLTSYTPYQPEISQGILQALFEYQSLICDLTGMDVTNSSMYDGFTALAEAVRMAYRINGRSEVLIPENLYKSKRSVINNYIHGLGIKLIEYKFNNGLIDLEDLNNKIGSNTCAIIGEIPNSYGILDKNVFEIKDIKKDSILISYYDPVSLGIIKPPGEYDADIAVAEGQQLGIHMNYGGPLLGLFSFKKDYIHKSPGRLIGESNDVNGRRAFVMTLQAREQHIRRARATSNICSNQALLAIAASVYLSVNGASGLYNIAMKTIENSEKLRRSMKSIGIEPVFNQRSFSDNLFNVKIKDFDEKLKNNDIAGGIKYRDLTGSGEDTWRFFSVTEMNDDNDFNALLKLGD

SEQ ID NO: 27698 - protein, 267 aa, Petunia sp.
MAATTMALSSSSFAGKAVKLSSSSSEITGNGKVTMRKTVTKAKPASSSSPWYGPDRVKYLGPFSGEAPSYLTGEFPSDYGWDTAGLSADPETFAKNRELEVIHCRWAMLGALGCVFPELFARNGIKFGEAVWFKAGAQIFSEGGLDYLGNPSLVHAQSILAIWACQVVLMGAVEGYRVAGGPLGEVIDPLYPGGSFDPLGLAEDPEAFAELKVKEIKNGRLAMFSMFGFFVQAIVTGKGPLENLADHLADPVNNNAWSYATNFVPGK

SEQ ID NO: 27699 - protein, 92 aa, Arabidopsis thaliana
MSSRKSRSRQTGASMITDEQINDLVLQLHRLLPELANNRRSGKVSASRVLQETCSYIRNLSKEVDDLSERLSQLLESTDSAQAALIRSLLMQ

SEQ ID NO: 27700 - protein, 465 aa, Picrophilus torridus
MYKQAYYNEPYLKDFGFNSIKGIDFDINLKRKSIKLMDYNEFDVSRHYTRLSQMNYSVDLGMYPLGSCTMKYNPKYADKISGMESFQEMHPLMNDECSQGTLKVMYLLQDYLKKISGLDYVSLQPSAGAHGEFTGILIIRKYFEDLNQLDTRREIIIPDSAHGTNPASASMGGFDVIEVPSDENGLVDLDALKNAVSERTAAFMITNPNTLGIFDDNIMKISEIMHKNGALLYYDGANFNAILGITTPGIMGFDIVHFNLHKTFATPHGGGGPGAGPVAVRSFLKDYLPVPLVSFKNGMYYLDYNIPKTIGKVSSYYGSFSILIRALSYIIKNGNYLKERTVKAVLNSNYMSHQLSGYYKIPYKELKKHEFVLSTENTGKKALDIAKYLLDYGVHPPTTYFPLIVKEAMMIEPTESATKKDLDYYIEAMVNALKADDNDLKMAPLNTSVSRIDELKAARQLKLHW

SEQ ID NO: 27701 - protein, 265 aa, Polystichum munitum
MATSTAALTSTFSGQQLKPVNELSRKVGAGEARVQMMAPKSKAPSGSIWYGSDRPLYLGPFSGSPPSYLSGEFPGDYGWDTAGLSADPETFAKNRELEVIHSRWAMLGALGCVTPELLAKNGVKFGEAVWFKAGSQIFAEGGLDYLGNPSLVHAQSILAIWACQVILMGAVEGYRVAGGPLGEVEDPIYPGGSFDPLGLADDPEAFAELKVKELKNGRLAMFSMFGFFVQAIVTGKGPIENLSDHLADPAVNNAWAYATNFTPGK

SEQ ID NO: 27702 - protein, 718 aa, Rhizobium leguminosarum
MSFSFSELDFLKPELGAEYTGSGTHFAVFSAHAEQMELCLFSPDGKNEIARLPLPKREGDIWSGYIAGVGPGTVYGYRAHGPYDPQAGHRFNPNKLLLDPYAKQVTGELKWDDALFGYQIGEDDLSFDARDSAPFTVKGVVQDPDFDWAGEEAIRRPWPDTIIYEAHVRGLTMTHPKVPDRLRGTFLGMCSDPIIDHLVKLGISAIELLPIQYFLDDRYLLENNLRNYWGYQTLGFFAPQSRYMSGDKITEIKTMVKKFHAAGIEVIMDVVYNHTAEGSEKGPTLSFRGLDNASYYILSPDDPRHTYDTTGTGNTLNAANPMVMRMVLDSLRYWVGVMHIDGFRFDLASTLGRQDMEFDRQGLFFGAIRQDPILAGVKLIAEPWDVGDGGYQVGGFPHPFREWNDKFRDDVRRFWKGDGGMVSEISQRITGSAVQFNHSDRGATSSINLLSAHDGFTLMDTVSFDDKHNDANGEDNRDGHSDNHSDNMGAEGVTDNEDINSLRARRRRNMMATLMLSQGVPMILAGDEVGNSQGGNNNAYCQDNEIGWTDWSGLDDPFLDFCRQAVAFRKAHPVLRQERFLTGETAEDGRIEIAWYKPDGGFMDEGAWNDDGLQVLGVYVSRSVHAPDTEEMDDLFLVFNAGGDCEVHLPVVNGLKQWSRVLDTGSETASFEVREPENPVIVYAQSVAVFAPKGQTEPPKGATKAERRRWFQFGRRSK

SEQ ID NO: 27703 - protein, 843 aa, Francisella tularensis
MKRILINSKSGEETRIATLDNGKLIDLDIESVDREQKKANIYKGYISRIEPSLNAIFVNYGEEKNGFLPFKEVSEYYLKDVPNGENIAPLLSEGQELIVQIDKEERGDKGAALTTFITLAGSYMVLLPNNPEGGGISRRVEGEDRERLKKYLKELNIPKNMSVIARTACVECSFEELKHDFDTLVELWGSISQAYHRIKKPALLHKESDIIVRTVRDHLKEDVKEIIVDSKECFEDVKRQLILLRQSFDINKVKLYNEELPLFAQFGIDQQIENAYKREIRLPSGGSIVIDTTEALVAIDVNSSRANKAEDVETTAFKTNLEAAEEVARQLRIRDLGGLVIVDFIDMSFYPNRKQVEEKLMEALQQDRARIQMSRISKLGLVEISRQRLSSSINESVMQKCPRCEGHGFIKTTQATALTILRKIRAEAIKEDTNEIRVQVPVDIAAYILNEKRDSIVEIERISQVKVMIIPNFNMESPKFQMQRIWGTSYKSNRTSSELIEDVYNIEIPKAGKKKIAAVDLNQAIENQAASNTQEQKPQTDAQVDIVTQNDKKQDDVTQQAKKKGFFARLFSGIFATDSKAAQQANNSAQKQQNKEQNFQRQQQHNKAQKDNNQRNERNNSNNKNERNKNKSNNDKFDKKSNNRNSRSNNLNLNNAEEVIDITQLKYQNQTAIAKTDNIKKVISKNPDEFISVMVKDVLENYDSLKDNGATKIATQEKIKTNKYLKFDTVSVDTEIALLNEVAKSNQTVGVEQITAETEESLSIVDKVDDITIPEVVVEQEKPAKVVKETNQTSEAKPKKEKQTTTKNNKKEKPAEKEMKQNQAKPEYINYSPAIDFESQALI

SEQ ID NO: 27704 - protein, 542 aa, Oryza sativa
MGNQCQNGTLGSDYHNRFPREHAVGYVQGDSYLDLKKFDDTWPEVNNFKPTAASILRRGLDPTSINVLGRKTADLREHYIIGRKLGQAQFGTTYLCTEINTGCEYACKTIPKRKLITKEDVEDVRREIQIMHHLSGHKNVVAIKDVYEDGQAVHIVMELCAGGELFDRIQEKGHYSERKAAELIRIIVSIVAMCHSLGVMHRDLKPENFLLLDKDDDLSIKAIDFGLSVFFKPGQVFTELVGSPYYVAPEVLHKRYGPESDVWSAGVILYVLLSGVPPFWAETQQGIFDAVLKGHIDFQSDPWPKISDSAKDLIRKMLSHCPSERLKAHEVLRHPWICENGVATDQALDPSVISRLKQFSAMNKLKKLALRVIAERLSEEEIAGLREMFKAVDTKNRGVITFGELREGLRRFGAEFKDTEIGDIMEAAHNDNNVTIHYEEFIAATLPLNKIEREEHLLAAFTYFDKDGSGYITVDKLQRACGEHNMEDSLLEEIISEVDQNNDGQIDYAEFVAMMQGSNVGLGWQTMESSLNVALRDAPQVH

SEQ ID NO: 27705 - protein, 477 aa, Mesorhizobium loti
MSRQAQAPTIVLFRRDLRMGDNAALAAAAERGVPVVALYILDETTKGLRAMGAASRWWLHHSLAALGDLLRKAGANLFLAHGRTEDAVAKAIDASGANCVFWNRRYDPSEVAVDARLKAALREKGLTALSFDGALLHEPSLLKTGSGGFYKVFTPFWKAMADKVDVRDPIDTPGQIDGWRGELGGLRLDELDLLPSKPDWAYGLRETWTPGEKGAQARLGQFIEHGLANYERQRDYPGQPSTSRLSPHLTFGEITPFQIFAALRRSKSSGTSKFRAEIGWREFSYHLLFHNPDLSGRNFRPEFDAMSWRDDIRALRTWQRGLTGYPIVDAGMRELWRTGWMHNRVRMIVASFLIKDLMIDWRHGEKWFWDTLVDADAANNPASWQWVAGSGADPAPYFRIFNPVLQGEKFDPHGDYVRQHVPEISALPDRYIHRPWEAPAAVLKDKGIVLGKTYPNPIVDHGAARERALIVYQSLKD

SEQ ID NO: 27706 - protein, 178 aa, Prosthecochloris aestuarii
MKAETIMPLYSARAIRKRVAELGLTITENYRETQQLTVLCVLKGAFIFTADLVRNIKVPCTIEFLRASSYGNMTSSSGEVFIQHDLDISNKDVLVIEDIVDSGLTLQRIIGELDSLGPSSLKVCALLDKPAARRYPVTIHYRGFSIQNVFVVGYGLDAGGKYRELPFIGMLEQITCSS

SEQ ID NO: 27707 - protein, 517 aa, Arabidopsis thaliana
MAMAMALRRLSSSIDKPIRPLIRSTSCYMSSLPSEAVDEKERSRVTWPKQLNAPLEEVDPEIADIIEHEKARQWKGLELIPSENFTSVSVMQAVGSVMTNKYSEGYPGARYYGGNEYIDMAETLCQKRALEAFRLDPEKWGVNVQPLSGSPANFHVYTALLKPHERIMALNLPHGGHLSHGYQTDTKKISAVSIFFETMPYRLDESTGYIDYDQMEKSATLFRPKLIVAGASAYARLYDYARIRKVCNKQKAVMLADMAHISGLVAANVIPSPFDYADVVTTTTHKSLRGPRGAMIFFRKGVKEINKQGKEVLYDFEDKINQAVFPGLQGGPHNHTITGLAVALKQATTSEYKAYQEQVLSNSAKFAQTLMERGYELVSGGTDNHLVLVNLKPKGIDGSRVEKVLEAVHIASNKNTVPGDVSAMVPGGIRMGTPALTSRGFVEEDFAKVAEYFDKAVTIALKVKSEAQGTKLKDFVSAMESSSTIQSEIAKLRHEVEEFAKQFPTIGFEKETMKYKN

SEQ ID NO: 27708 - protein, 493 aa, Candida albicans
MLSSTLRRSVRAQSKNLPAFARRTYAVSPSAQALISKSVQDVDPEMADILNQERTRQKNSITLIPSENFTSKAVMDLLGSEMQNKYSEGYPGERYYGGNEIIDKAEALCQKRALEAFGLDPSQWGVNVQPLSGAPANLYAYSAILEVGDRIMGLDLPHGGHLSHGYQTKTTKISYISKYFQTMPYRLNEETGIIDYDTLEKNAQLFRPKVIVAGASAYSRVIDYKRMRQLSIRLGAYLLSDMAHISGLVSAVVTDSPFPYSDIVTTTTHKSLRGPRGAMIFFRKGIRKVTTKGKEIPYELERKINFLVFPGHQGGPHNHTISALAVALKQCTEPEYVKYQQEVVSNAKHFADALVSKGFKLVSDGTDTHLILVDLRSRNIDGARVEAVLERANIAANKNTVPGDVSALFPSGLRVGTPAMTTRGFGPEEFDKVAEFIDQAVNIAIELKAQEQGKVPKELLASFKKLADESDKVKQLDKEVVSWVSKYPVPGEL

SEQ ID NO: 27709 - protein, 413 aa, Unknown
  uncultured archaeon GZfos28B8
MNERKKIGIITSGGDCGGLNAVIKGVSSMANYYGLENVVIPNGYAGLYNLIDFETDDLISLDYIRMGLFHSNIAGSEAGHSRVKISKLDDETKYDRIKQGLDKHSIDALVVSGGDDTGSVALDLLNNGIAINHVPKTMDFDLQSYSVGGDSAINAISKMAANLRTTARSHNRIMILEVFGRYAGHAAFRGGIAADADCIIIPEVAPDFDVIYEDMFAKYTERIKKSDVKAGSYLIVVSEALKGNKPEDDVDERGFLIDKTRGSDAFGHYPLAGSGKTIEAELKKRMKNDVKMKQFMEQVHMYVQGQYEIPEIRVIRPTHLVRCGDSSAYDANFGKECGAGAVILLMQNITGATVTGVRNGVVEYMDISEAIKQNTVNLDQVALHEALGICFGRKTQKTGFEKKMKLDTVNRYL

SEQ ID NO: 27710 - protein, 470 aa, Candida albicans
MSAYALSQSHRQLTEGHLKDTDPEVDQIIKDEIDRQQHSIVLIASENFTTTAVFDALGTPMCNKYSEGYPGARYYGGNEHIHRMELLCQERALKAFGLTPDKWGVNVQTLSGSPANLQVYQAIMKPHERLMGLDLPHGGHLSHGYQTDSRKISAVSTYFETMPYRVDLETGLIDYDMLEKTAVLYRPKVLVAGTSAYCRLIDYKRMREIADKVGAYLVVDMAHISGLIAAGVIPSPFEYADIVTTTTHKSLRGPRGAMIFFRRGVRSVNPKTGQEILYDLENPINFSVFPGHQGGPHNHTIAALATALKQANTPEFKEYQEQVLKNAKALESEFTKKGYKLVSDGTDSHMVLVSLKDKQIDGARVETVCEKINIALNKNSIPGDKSALVPGGVRIGAPAMTTRGLGEEDFKKIVSYIDFAVNYAKEVQSQLPKDANKLKDFKNAVSGDSEKLKAVRDEIYQWAGSFPLAV

SEQ ID NO: 27711 - protein, 536 aa, Desulfitobacterium hafniense
MAGLATSFGSGAMTNSINEIPNAEVMFVIGSNTTEAHPIIGTKMKQALARGAKLIVADPREIELARDAHIWMRLKPGTDIALINGIMNIIVENGWEDRAFIEERTEGYQELRENLKKFPPEEVSKITGVPVELMAEAARLYTSVERAQIFYTLGITEHVCGTDNVMSLANLAMLTGNIGKESSGVNPLRGQNNVQGACDMGALPNVYPGYQSVTNPEARAKFEEAWGVSLNPNQGFMIPDMFDSAVKKELRAMYIMGEDPVLTDADANHVRKGLKALDFLVVQNIFMSETAELADVILPGASFAEKDGTFTNTERRVQRVNRAIKPIANTKADWEIICELSNRMGYPMAYPSPAEIMLEVASLAPQFAGVTYERLGKKGLQWPVPHAEHPGTKFLHQGKFTRGKGVFTVIEHQLPDELPDEEYPFLLTTGRKLQHYNISTRFSAALDEHAPEELAELNPKDARRLGIQDGEKIKVVSRRGEVVTKVWVTKRVPPGVLFMTLHYRESPTNVLTNGAYDKVTKTYEYKVCGVRVEALK

SEQ ID NO: 27712 - protein, 356 aa, Mycobacterium tuberculosis
MAQREWVEKDFYQELGVSSDASPEEIKRAYRKLARDLHPDANPGNPAAGERFKAVSEAHNVLSDPAKRKEYDETRRLFAGGGFGGRRFDSGFGGGFGGFGVGGDGAEFNLNDLFDAASRTGGTTIGDLFGGLFGRGGSARPSRPRRGNDLETETELDFVEAAKGVAMPLRLTSPAPCTNCHGSGARPGTSPKVCPTCNGSGVINRNQGAFGFSEPCTDCRGSGSIIEHPCEECKGTGVTTRTRTINVRIPPGVEDGQRIRLAGQGEAGLRGAPSGDLYVTVHVRPDKIFGRDGDDLTVTVPVSFTELALGSTLSVPTLDGTVGVRVPKGTADGRILRVRGRVCPSAVGVAATYLSP

SEQ ID NO: 27713 - protein, 113 aa, Prosthecochloris aestuarii
MKYIVAMIQPHKLPDVKAALAEAGIFKMTVTNVLGCGAQGGYTEIYRGVPNEINLLKKLKIEIGVNDDFEKKTVDAIIKGAKTGEIGDGKIFVFDMPKCIRIRTEETGNDAIG

SEQ ID NO: 27714 - protein, 372 aa, Ralstonia metallidurans
MQSVIAQAKRIVVKVGSSLVTNDGKGLDHDAIARWAAQIAKLRGTGKEVVLVSSGAIAEGMQRLGWARRPKEIHELQAAAAVGQMGLAQVYESQFGRYGIRTAQVLLTHADLADRERYLNARSTLLTLLSLGVVPIINENDTVVTDEIKFGDNDTLGALVTNLIEGDALVILTDQRGLYTADPRKDPNAEFVHEALAGTPELEAMAGGAGSSIGRGGMLTKILAAKRAAKSGAHTTIASGREADVLGRLAAGEAIGTQLLAPTGRLTARKQWMADHLQLRGRVIIDAGAVEKLTSGGKSLLPIGVVEVQGEFARGEVIACASPEGKEVARGITNYSSAEARLIARKPSSEIESVLGHLNEPELIHRDNLVLV

SEQ ID NO: 27715 - protein, 335 aa, Sulfolobus tokodaii
MQQLNQHNEIYDVIIVGAGIAGLSAALYTSRQRMKTLVVSKDLGGQLTLTDLIENYPVVEPLSGLSLARKVESQAKRFGAKFIYGEEIYKIDKKGDIFELQGILGSYKAKTVILAFGKTPRELNVPGEKEFKGKGVSYCAICDAAFFKDKPAAVVGEGEPGVEAIELLSKYARPAYYISMSTQLVGGDEGTLKSILNNENIKMFLGYKVIRIIGNSKVEGIVIQNSKTKEDKILNVDGVIIEMGYVLRTEFLKDFIKLNEKGEIIVDELGRTNVEGIFAAGDVTNTPYKQAVVAAAEGVKAALSAYNYLRSKSGLPPVNVDWKAEKQKAVVSFRL

SEQ ID NO: 27716 - protein, 260 aa, Brassica oleracea
QLMTWKTAVANIPYGGAKGGIGCDPSKLSISELERLTRVFTQKIHDLIGIHTDVPAPDMGTGPQTMAWILDEYSKFHGYSPAVVTGKPIDLGGSLGRDAATGRGVMFATEALLNEHGKSISGQRFVIQGFGNVGSWAAKLISEQGGKIVAVSDITGAIKNKDGIDIESLLNYTKEHRGVKGFDGAHPIDANSILVEDCDILIPAALGGVINRENANEIKAKFIIEAANHPTDPDADEILSKKGVVILPDIYANSGGVTVS

SEQ ID NO: 27717 - protein, 382 aa, Blastopirellula marina
MTDLLRQEIAATADLIVVKVGTRVLTAPDGTLNRERIAQFAEEMSRLLDSGRKMVLVSSGAVGAGMDRLKLKQRPTDLARLQAVAAVGQARLIEAYDQTLAVHGRHGAQVLLTAEDLDHRVRYLNIRNTLVSLLEFGVLPIINENDTVAVDELMTTFGDNDRLAARVTNLLRAPLLVILSDVAGLYDRSPDDPQAQVIPVVHKFDDQLMSFVRDKKTGLSKGGMASKLEAARLVTTAGENVIIASGRDPQAITKIVAGETIGTLFLPQGKTVSPRKRWIGFSVEPRGRITVDAGAKRAVEESGRSLLAIGVVGVEGDFEKGDVVRVCGPEGNEVARGLTNYSAAEVARIRGIQSDKISDILGHCPYVELIHRDNLTLSRAAK

SEQ ID NO: 27718 - protein, 995 aa, Listeria innocua
MGAKVSVRINGEARDVVEGTRILDYLNAEGIQHPHICYSEQIGPIQSCDTCMCEVDGELMRACSTNLTDGMEIKTNSELAKDAQLEAMDRILENHLLYCTVCDNNNGNCKVHNTTELLGVEKQDRPYREKGYLNDFTHPFYRYDPDQCILCGRCVEACQQVQVNETLSIDWERSQPRVIWDDDRPANLSSCVSCGLCATVCPCNALMEKSMLGQAGFMTGLDEDMLEPMIDMVKKVEPNYQTVFAVSEMEAAMRETRTKKTKTVCTFCGVGCTFEVWTKDRKILKVEPTGEGPVNKFATCVKGKFGWDFVNSEKRITTPLIREGNEFVPASWEDAIHLVATKLREIQAKYGNDSIGFISSSKTTNEENYLMQKLARQVFETNNIDNCSRYCQAPASDGLTRTVGIGADSGTVEDIESAGLVIIVGASPADGHPVLASRIKRAQKTRGQKLIVSDLRKHEMAERSDLFIHPKQGTDFVWLTAVAKYIIDQNWHDQVFMENRISNVADYLAFLEPFTLEYAEKETGLPAETLKLVAEMIHEADGTAVCWGMGVTQNIAGSHTSSAIANLLLVTGNFGRHGAGAYPLRGHNNVQGACDMGSLPNVLPGIQPLGNDEVRARFEEAYGVSISPEPGLKNNEMLDAIEAGTLHSMYVIGEEMAWVDSNSNHVQEILSSLDFFVVQDVFLSKTAQFADVVFPAAPSLEKEGTFTNTERRVQRLYEVLEPLGDSKPDWWIIQEVARACGRTDWNYDHPSEIMDEIASLAPFFAGVRYDRMQGFNSLVWPVSADGKDMPLLYEERFNFPDGKAQFSTLPYIAPITFPEEFNLTLNNGRLLEQFHEGNLTDKSKGLDYKLPEVFVEVSHELAKERDIESGSLVRLSSPYGRIKLRAVVTERMKGNEVYVPMHSVSSETAVNLLTSSAGDVRTKTPAYKQTKVNLTVLEKTGKNPLPDHNPRNRKRFPQNGAEVERKWSREDYQPISKVNCACGGNCGCGGKGRNH

SEQ ID NO: 27719 - protein, 1147 aa, Yarrowia lipolytica
MYQLLKALNAKVYSQQREIALHSGAVVALERDLSQTRNILNSFTETIAPGEKRVVDTDLLDRELRKSQTANRAFQKALMEIGEVVFAVAQGDLSKKVTIHDQEMDPEIVKFKETINKMMSQLQRFASEVTRVATEVAGGTLGGQAEGEGTVGVWRELTDNVNVMASNLTNQVREIADVTRAVAQGDLSRKINVHAQGEILELQKTINTMVEQLRTFAFEVTRVARETGVEGRLGGQAQIEGVEGIWRELTDNVNAMASNLTDQVRNIANVTTAVARGDLSQKVSADCKGEILDLKSTINKMVDRLQNFALEVTTLARSVGTEGILGGQAKVEDVEGAWKEITENVNVMASNLTTQVRSIAHVTTAVAQGDLSQKIDVHAQGEMLALKSTINKMVDRLQVFASEVTRVAKDVGIDGKLGVQAQVSDVDGLWKEITTNVNTMAANLTTQVRALVQITAAATDGDFTRFITVEASGEMDALKTKINQMVLNLRESIQRNTAAREAAELANRAKSEFLANMSHEIRTPMNGIIGMTQLTLDTELTQYQREMLSIVHNLANSLLTIIDDILDISKIEANRMTIEKIAFSLRGTVFGALKTLSVKANEKPLDLVYKVDNTFPDNLVGDSFRLRQVILNLVGNAIKFTESGEVALSVRKADDQRPGSPDEMMIEFCVSDTGIGIQSDKLDVIFDTFCQADGSTTRKFGGTGLGLSISKRLINLMGGDIWVKSEYGKGSQFFFTLAVQPADSGLSQLLDNIAPFRNHYVLFINTEHEQEVVDQLVDNMQRLNLNAWVVDSLEEAPLPEDRSGPKFDTIIVDSLEVATKLRTLNHLKYIPLILLHPCIPQVNLKICLDLGITSYGNTPCSTNDIGNVLLPALESRAAPLNSDGQMKFQILLAEDNVVNQKLAVRILEKHQHRVEVVENGYEAFEAIKKKRYDVVLMDVQMPVMGGFEATAKIREWEKQNITIRTRTPIVALTAHAMLGDRERCMQAQMDEYLSKPLKPALLVQTINKCVHSVNQLRSLALGPTSTSSVNQILSRSGQHKSAVAASSSAASASMLPYVAPQPTSPVLSPSLEDAIIKTTDGVVSKSPLPPSQSKPRPTIEQRSRTVTSVPHVDYPENGGARIVAIDEGTEPEKESEQPPSNRRVNSN

SEQ ID NO: 27720 - protein, 401 aa, Zea mays
  misc_feature (30)..(30): Xaa can be any naturally occurring amino acid
  misc_feature (49)..(49): Xaa can be any naturally occurring amino acid
MAVLSAADASPVSAIRFEGYEKRLEITFSXEAPVFVDPHGSGLRALSRXQIDSVLDLARCTIVSELSNKDFDSYVLSESSLFIYPLKIVIKTCGTTKLLLTIPRILELAEELSMPLAAVKYSRGTFIFPGAQPAPHRSFSEEVAVLNRYFGGLKSGGNAYVIGDAARPGQKWHIYYATEYPEQPMVNLEMCMTGLDTKKASVFFKTNADGNTTCAKEMTKLSGISEIIPEMEICDFDFEPCGYSMNAIHGSAFSTIHVTPEDGFSYASYEVMGLDATALSYGDLVKRVLRCFGPSEFSVAVTIFGGRGHAGTWGKALGAEVYDCNNMVEQELPGGGLLVYQSFCAAEDAVATSPKSVFHCFDGENVESAPPPMKKDYKLANLLCWEEEADAMEEKAGVLDE

SEQ ID NO: 27721 - protein, 522 aa, Clostridium cellulovorans
MKKIIATATSLCLSAGIILPATEAAAAPKFDYSDAFGKSIMFYEANWSGKVENNRFDWRGDAFLKDGADVGLDLSGGFFDAGDHVKFGLPQAYAASTLGWGYFAFKDAYKSNGQDAYMLKILKHFTDYFLKCYPDNNTFYYQVGDGDLDHAYWGPPEIQPTARPTKFKATPSDPASDVCGNTAAALAIMYLNYKDVDATYANKCLTAAKNLYSLGKNYKGLSHGQSYYVSTSYYDDLAWGAVWLYQATNDNSYMTDANSFLSQINADGDKVYTSYWTHCWDNVWTGVIYKMAEVTGKANYKASVENNLNYWMNNIKTTAGGLKFATDWGSLRYSSTQAMLALIQYNRTKEQKYLDFATRQIDYILGDNPRSSSYVVGFGNNYPKFPHHRGASGRLEPGEMKTMPEKHILTGALVGGPDGNDQYKDDINNYQQTEVAIDYSAGFVGAMAGITKYLDPAPIIIDPITYALGDVNKDGKVNAIDLAILKKNLLNGITGDLTVSDMNKDGKVNAIDLALLKKLLLG

SEQ ID NO: 27722 - protein, 921 aa, Oryza sativa
MSVLNPPPKRRAISAIRKFPRDCGRAASTLAESGASMEELPLEATPISVATGGASMEDSLARTPISVQGASLVCGLDHSSEAIDGKTIEDDESSKVENRIQEFQVATNVAEDDFEGAKNGSTHPNDSIAKPSPSHGFVERVNGKGSQQEKKLVARSAGDGKMVSKYEERLQKGTPETRMRDLVDVKAKKKILKSDKMNGALQNDARSSGDGKMKTKASSTQRGVVRSDMSLKQGDIARKVDATGKCKGGVNSLIKEATSGKHATTNGIEENDDRDLVSDRIIVQALMAPDKCPWTRRRKSIGGSSESRTPKLKKKFGRPRKELKDTTPREEVSPEVASCKAIKHEAIEDKEDSYFEDEGNSKASYSDVEGNSKELVRGGKALVVCGGKKELCVTLPPSAPFGTDPRSKIRNLLIKFHAACRKLVQVEEQHKGNIGRIDIEAGKALKQNGFIKPGPIVGNVAGVEVGDEFNFRIELSFVGLHRPYQGGIDSTKVNGILVAISPRAAGIGTRELSSSDELIYTGSGGKAIGNKAAGDQKLERGNLALKNSIETKTPVRVIHGFKGHSKGEASHSKSKQISTYIYDGLYMVVDYWKEGPEGSMVYKYKLQRIPGQPELALHIIKATRKSKVREGVCVPDISQGRERIPIPAINTIDDTQPTAFKYTTEVIYPHSYAKEPPKGCDCTNGCSDSNRCACAVKNGGEIPFNSNGAIVEAKPLVYECGPSCRCPPTCHNRVSQHGIKIPLEIFKTGNKGWGVRSLSSISSGSFVCEYAGEVLQENGDEHVETDEYLFDIGHHYHDEVWEDPKFEGILGLESSTSKTTEDTEGSKTTEDTEGSTIDASKCSNVGRFINHSCSPNLYAQNVLWDHDDMKKPHIMFFATENIPPLQELTYDYNYGKVEDKNGKEKVKPCFCGSPDCSRRLY

SEQ ID NO: 27723 - protein, 450 aa, Hordeum vulgare
MAMPPAEKVIVVDANPSKNGHGDEIDDLPVADATSHQIGVDPWYQVAFVLTTGVNSAYVLGYSGSLMVPLGWVGGTVGLLLAAAVSMYANALLGRLHLLGGKRHIRYRDLAGHIYGPKMYRLTWAMQYVNLFMINTGFIIIAGQALKALYLLISNDGAMKLPYCIAVSGFVCALFAFGIPYLSALRIWLGFSTVFSLTYIVAACTLSLKDGMRSPPRDYSIQGDPSSRVFTTIGAAASLVFAYNTGMLPEIQATVRAPVVKNMEKALWFQFTAGCVPLYAIIVIGYWAYGNQTTTYLLNNVHGPVWIKAVANLSAFLQTVIALHIFASPMYEYLDTRFGSKVGGPFAMHNVIFRVGVRGGYLAVNTLMAAMLPFLGDFMSLTGALSTFPLTFVLANHMYLVSNRQRLSSLQKSWHWLNIVFFTILSITAAIAALRLIARDSKEYHIFADV

SEQ ID NO: 27724 - protein, 377 aa, Lactobacillus sanfranciscensis
MADKNYYDILGISKDATDKDISHAYRHLSKKYHPDINKEPGAEAKFKEITEAYEALSDKQKRANYDQYGSADGPQGFGGGGQGGGFGGGANYGDFSDIFSDLFGGGRRQRQDPTAPRRGEDLQYQLNLTFDEAIFGAKKTITYHRQAQCPDCHGTGAKPGTHPETCPDCYGSGVVMRTVNTPMGQMQTQTACPKCHGTGKIIKEKCPKCGGIGKIEEEHKVEVNVPAGVEEGQQMRLQGQGNAGENGGPYGDLYIIFSVSPSKEFRRNGSTIYYDKTISFTDAALGNEIDVKTVYGDGKLKIPAGTQTGTVFKLRGKGAPRLHSESKGDELVKVMIDTPKKLNADQKLALRAFAEASGDKSQENKGFFEKLKDKLNK

SEQ ID NO: 27725 - protein, 566 aa, Emericella nidulans
MADIATRDVRQPIDIAEYLFRRLHEVGIRSVHGVPGDYNLAALDYLPKCGLHWVGNCNELNAGYAADGYARVNGIAALVTTFGVGELSAINAIAGRYSEFVPIIHIVGQPHSRSQKDGLLLHHTLGNGDYNVFSSMNKGISVTTANLNDTYDAATLIDNAIRECWIHSRPVYLALPTDMITKKIEGERLKTPIDLSLPANDPEKEDYVLVDARAQVFARSAKNPVILVDDSCVFDDSTGLSLEEVHDLIEVSGLPTFVAPMGKGAVNETHRCYGGVYAGTGSNPGVREQVESSDLILSIGAIKSDFNTAGFSYRIGQLNTIDFHTTYVRVRYSEYPDTNMKGVLRKVIQRLGFIKADPVPHISNALPEHEKNSSEQRITHAWMWPMVGQWLKENDIVITETGTANFGICWNLLPSELQPISQVLWGSIGYSVGACQGAALAAKEQGNRRTVLWVGDGSLQLTLQEISTMIRNNLNPIIFVICGEGYTIERFIHGWDESYNDIQTWDIKGLPVAFGGKGRYKGYKVTTRDELTKLFASEEFSSTPCLQVSLCDLTHYLSDANFEQLG

SEQ ID NO: 27726 - protein, 751 aa, Vigna unguiculata
MELLQNGTKAKPSEIPLVNGTALTHLNSLFQTQFSGNIDPSRAFVSKVKRLIVKVGTAVVTRSDGRLALGRIGALCEQLKELSSQGFEVILVTSGAVGLGRQRLRYRKLANSSFSDLQKPQGELDGKACAAVGQSSLMALYDTMFSQLDVTSSQLLVNDGFFRDAGFRKQLSDTVNALLDLRVIPIFNENDAVSTRKAPYEDSSGIFWDNDSLAGLLALELKADLLVLLSDVEGLYSGPPSDPNSKLIHTYVKEKHQGEITFGDKSRLGRGGMTAKVNAAVCAAHAGIPVIITSGYATNNIIRVLQGERIGTVFHKDAHLWSNIKEESAREMAVSARESSRRLQILKSEERSKILLAIADALEKNASAISLENEADVADAVLAGYENSLISRLTLKHEKISKLAKSVRMLAAMEEPIGQILKRTEIADKLILEKISCPLGVLLVIFESRPDALVQIAALAIRSGNGLLLKGGKEAQRSNAILHKVITSVIPNTVGDKLIGLVNSRDEIPYLLKLDDVIDLVVPRGSNKLVSQIKESTKIPVLGHADGICHVYVDKSAKIDMAKQIIRDAKTDYPAACNAMETLLVHKDLSNNGGLNELVVELQREGVKLYGGPRASGILNIVETSAFHHEYSSLACTVEIVEDVFDAINHIHEHGSAHTECIVTEDREVAETFLSQVDSAAVFHNASTRFCDGARFGLGAEVGISTSRIHARGPVGVEGLLTNRWILRGSGHVVNGDQGINYTYKELPLEA

SEQ ID NO: 27727 - protein, 181 aa, Zea mays
  misc_feature (98)..(98): Xaa can be any naturally occurring amino acid
  misc_feature (141)..(141): Xaa can be any naturally occurring amino acid
  misc_feature (151)..(151): Xaa can be any naturally occurring amino acid
  misc_feature (156)..(156): Xaa can be any naturally occurring amino acid
  misc_feature (166)..(166): Xaa can be any naturally occurring amino acid
MGRRPARCYRQIKGKPYPKSRYCRGVPDPKIRIYDVGMKKKGVDEFPFCVHLVSWEKENVSSEALEAARIACNKYMVKSAGKDAFHLRIRVHPFHVLXINKMLSCAGADRLQTGMRGAFGKALGTCARVAIGQVLLSGRCXDNHGAHAQEXLRRPXFKFPGRQKIXVSRKWGSPRSTGLIT

SEQ ID NO: 27728 - protein, 713 aa, Thermus thermophilus
MEGTPNVPQAHRYELTLAGRPLVLETGKYAKQASGSVLVRYADTVVLATAQASETPVEADFLPLTVEFEERHYAVGKIPGSFMRREGRPGEKAILSARMTDRPIRPLFPKGFRHEVQIIVTVLSADQKNPPDILGPIAASAALMLSDIPWEGPIAAVRVGLIGGSFVLNPTLQELEESQLDLVVAGSKEAILMVEAEAGEVDEETLVQALEFAHKEMQPILELQEAMARELAKPKMAWTPPESLPEEEKEALYRLALERGLSQVLQTASKGERSRALAEFAERLIAEALPKGEDGTPDEGKKPLYESAFDEVVRRELRRLVLEEGKRADGRGPKDLRPIWIEVDVLPRAHGSAVFTRGETQVLGTVTLGTGRDEQILDDLGIDETEKFLVHYNFPPFSTGEVRRLRGVSRREVGHGNLAKRALKAVMPKEEDFPYTIRVVGDVLESNGSSSMATVCAGCLALMDAGVPIRAPVAGVAMGLVWEENRAVILTDILGLEDALGDMDFKVAGTRKGVTALQMDNKVGGLPREVLKEALLQAREARLKILDLMEAVLPAPRPELKPFAPRILSLKVPVEKIGLVIGPGGKNVRALEELGVEVDIEEDGTVRIYSSDLQAALEAKKRIEDLTREAKVGEIYEGTVTRITPFGAFISLFPGTEGLLHISQIAPGRVARVEDHLKVGDVIKVKVHRIDERGKIDLIRPELEGKIPPRRRR

SEQ ID NO: 27729 - protein, 162 aa, Parasponia andersonii
MSSSEVNKVFTEEQEALVVKAWAVMKKNSAELGLQFFLKIFEIAPSAKNLFSYLKDSPVPLEQNPKLKPHATTVFVMTCESAVQLRKAGKATVKESDLKRIGAIHFKTGVVNEHFEVTRFALLETIKEAVPEMWSPEMKNAWGVAYDQLVAAIKFEMKPSST

SEQ ID NO: 27730 - protein, 155 aa, Brassica napus
DVRQALYASKICSYAQGMNLLRAKSLEKSWNLNFGELARIWKGGCIIRAVFLDRIKKAYQRNPDLASLVVDPEFAKEMVQRQAAWRRVVGLAVSAGISTPGMCASLAYFDTYRRARLPANLVQAQRDLFGAHTYERTDRSGAYHTEWTKLARKSN

SEQ ID NO: 27731 - protein, 398 aa, Arabidopsis thaliana
MDSNFHYSIDLNEDQNHHEQPFFYPLGSSSSLHHHHHHHHHQVPSNSSSSSSSISSLSSYLPFLINSQEDQHVAYNNTYHADHLHLSQPLKAKMFVANGGSSACDHMVPKKETRLKLTIRKKDHEDQPHPLHQNPTKPDSDSDKWLMSPKMRLIKKTITNNKQLIDQTNNNNHKESDHYPLNHKTNFDEDHHEDLNFKNVLTRKTTAATTENRYNTINENGYSNNNGVIRVCSDCNTTKTPLWRSGPRGPKSLCNACGIRQRKARRAAMAAAAAAGDQEVAVAPRVQQLPLKKNLQNKKKRSNGGEKYNHSPPMVAKAKKCKIKEEEEKEMEAETVAGDSEISKSTTSSNSSISSNKFCFDDLTIMLSKSSAYQQVFPQDEKEAAVLLMALSYGMVHG

SEQ ID NO: 27732 - protein, 342 aa, Glycine max
MAAENVVEFTDLPVKRPREEEEEEEEQTNGVSNDAVSTLPNDPQYPGISAVIPGWFSEISPMWPGEAHSLKVEKILFQGKSDYQNVMVFQSSTYGKVLVLDGVIQLTERDECAYQEMITHLPLCSISNPKKVLVIGGGDGGVLREVARHASVEKIDICEIDKMVVDVSKQFFPDIAVGFEDPRVTLTVGDGVAFLKNVPEGTYDAVIVDSSDPIGPAQELFEKPFFASVAKALRPGGVVCTQAESIWLHMHIIEDIVANCRQIFKGSINYAWTTVPTYPSGMIGFMLCSTEGPLVDFKHPVNPINENDSQQSRPLKFYNSEIHTAAFCLPSFAKRKIGSKTN

SEQ ID NO: 27733 - protein, 312 aa, Legionella pneumophila
MSVGCISMSKIAVVINPIAGGGRGKKVWKVLKPGLHALFEQTVYRISNRVNDLEAITDGLLAENPDSLLIIGGDGTLNHVLNGLIEKDKLKNPQTKIAFFNAGCGGDFTRQFPQQKMTEFLDRLSHNQFIKCDIGKITLANQLSRYFINIASCGLSGHVVLRVSKSKWLKKLGGTLNYLLHALTGLMTYRKTKVRVQIDDALPFDSSILLMAVCSGQYFGGGMHVAPMAKVNDGLFDVVSFNEFSKLNALLKLYKIYSGGHLLDNNVHYVQTKKIKIEPLEESKIEIEADGEIIGCLPAQFELIKETLPLII

SEQ ID NO: 27734 - protein, 614 aa, Arabidopsis thaliana
MAYYETMFDQLDVTAAQLLVNDSSFRDKDFRKQLNETVKSMLDLRVIPIFNENDAISTRRAPYQDSSGIFWDNDSLAALLALELKADLLILLSDVEGLYTGPPSDPNSKLIHTFVKEKHQDEITFGDKSRLGRGGMTAKVKAAVNAAYAGIPVIITSGYSAENIDKVLRGLRVGTLFHQDARLWAPITDSNARDMAVAARESSRKLQALSSEDRKKILLDIADALEANVTTIKAENELDVASAQEAGLEESMVARLVMTPGKISSLAASVRKLADMEDPIGRVLKKTEVADGLVLEKTSSPLGVLLIVFESRPDALVQIASLAIRSGNGLLLKGGKEARRSNAILHKVITDAIPETVGGKLIGLVTSREEIPDLLKLDDVIDLVIPRGSNKLVTQIKNTTKIPVLGHADGICHVYVDKACDTDMAKRIVSDAKLDYPAACNAMETLLVHKDLEQNAVLNELIFALQSNGVTLYGGPRASKILNIPEARSFNHEYCAKACTVEVVEDVYGAIDHIHRHGSAHTDCIVTEDHEVAELFLRQVDSAAVFHNASTRFSDGFRFGLGAEVGVSTGRIHARGPVGVEGLLTTRWIMRGKGQVVDGDNGIVYTHQDIPIQA

SEQ ID NO: 27735 - protein, 163 aa, Herminiimonas arsenicoxydans
MNTQTVYDFSSHSLSGAAVDLAQYRGKVLLIVNTASKCGFTPQYEGLEAVYRQFRERGVEVLGFPCNQFGGQEPGDAAAIGTFCEKNYGVTFPLFAKIDVNGDNADPLYQYLKHAAPGLLGSEAIKWNFTKFLIRKNGTVYKRYAPQTKPEELIEDINTLLAE

SEQ ID NO: 27736 - protein, 236 aa, Zea mays
MTVPDAESRFHVLAVDDSLVDRKLIEMLLKTSSYQVTTVDSGSKALELLGLRDASSPSPSSPDHQEIDVNLIITDYCMPGMTGYDLLKRVKGSSSLKDIPVVIMSSENVPARISRCLQDGAEEFFLKPVKLADMKKLKSHLLKRKQPKEAQAQQGQAVELEPEQQLDPRTQPAHDAEETAAEPPPAASNGTADGGNKRKAAAMEEEGMLAVMTVAAPESSTKPRLATTSSSLAVET

SEQ ID NO: 27737 - protein, 555 aa, Methanosarcina acetivorans
MEKLAKFKALGLSDSTLKALKKKGFEEPTPIQEKVIPLFLKGESDIIGQAQTGTGKTTAFGAPIIEKIPEKSGYVQAIILTPTRELAIQVSEELNSIKGDKKLHVVPIYGGQSMTQQLRVLKSGVDIVVGTPGRIIDHLERKSLDLEHIAYFVLDEADEMLNMGFIDDIKEILKATGPDKRMLFFSATMPKPILGIVKKYMQNYEHVTIEKEELAAKLTEQIYFEVQENDKFEALSRIIDIEDEFYGLVFCRTKTDTGQLAQKLSDRGYEADALHGDLSQQEREKILNKFRKQKINVLVATDVAARGIDIMDLTHVINYSLPQDPESYVHRIGRTGRAGKQGTAITFVTSTEFRRLTYIKKTSKSEMKKGRIPEIKDVIKAKRARVKAELEETIKTEEYGDCLEMSERLLEEYPAEKILAALLKYTFKEKFDESMYTEISSPSSYVDRKGKTRLFIAMGKADGMSPEKLSYFIQEELGDSELKVRDAEIFPHFSFVTLPFAQAEALLEIFKNKRRGRKPFVELAQKSKGRSLKGSNNGRSNGRPRNPSRPRNTKK

SEQ ID NO: 27738 - protein, 303 aa, Clostridium acetobutylicum
MNYIDDIRQIIGNTPIIKINNFGLNSGVNIFAKLELLNPGGSVKDRVGVYMIEDAEKKGKLKKGYTIVEGTAGNTGIGIALAAINKGYNVIFVVPEKFSIEKQTLMKAFGAKIINTPREEGMQGAVKKANELLSTIPNSISLGQFVNQANPLAHYETTGPEIYRDLEGNIDYVVAGAGSGGTYAGVLKFLKEKKPNIKGVLADPEGSTMGGGEEASYDIEGIGNDFIPDTMDMNLVDEVIKVNDAEAFHMVRQLALKEGLIVGSSSGAAMAAAIKLSKKIKSGNIVTIFPDRGDRYFSKNILG

SEQ ID NO: 27739 - protein, 401 aa, Mycobacterium avium
MTESAYLVGLRLTGKKVVVVGGGTVAQRRLPLLIASGADVHVISRSATRSVEAMTGITLQLREYRDGDLDGAWYAIAATDDPRVNEAVVAEAERRRIFCVRADVAVAGTAVTPASFSYAGLSVGVLAGGEHRRSAAIRSAIREALQTGVITPEGPVGSDAVKGGVALIGGGPGDPELITVRGRRLLAQADVVVADRLAPPELLAELPPHVEVIDAAKIPYGRAMAQDAINDVMIERARAGSFVVRLKGGDPFVFARGYEEVLACADAGIPVTVVPGVTSAIGVPALAGVPVTHRAVNHEFVVVSGHLPPGHPESLVNWDALAALTGTIVLLMAVERIELFAEALLKGGRPADTPVLVVQHGTTAAQHTLRATLADTPEKIRAEGIRPPAIIVIGAVAAFGV

SEQ ID NO: 27740 - protein, 715 aa, Unknown
  Candidatus Kuenenia stuttgartiensis
MIEINKNKGDRITMPIQWHKTTCPYCGFGCGLMAGVENGKIIEIKGMPGHPANDGMICTLPANSVPVFCAEDRLTKPMIRRDGKLSPVSWEEAITHVASRFQEIIETHGPGAIAIHSGATCTTEEYYLMNKLIKGCIGSNNIESSTRLCMASSAMGFMSTIGADAPPACYADIEQADLFFIAGNNMAISVPALFARVARSKRKNDAKVIVVDPRRSETTGIADIHLQIRPGTDVALNNSIAHVLLKEGYVNEEKVAEYASGIKDLKELSEEYPPSRASEITGCPEQLIIDAARMVGRSKAMLIFWFQGYNHSTQAVFKNNTLHNLWLLTNNFCKPGAGPLSITGECNALGCRWVGGLSHLLPGMRMVANPQHRQEVADFWGIPTEKLHPVPGRSIMDIVSGLHSGDVRALWVIAANPAASLPNTKWILDGLSKAEMLVVQDIFHPTETTKLADVVLPAAQWCEKAGTFISSERRIELADKIIDPPGEAKPDCEILWLVARAMGFEKEFPYSSPEDVFGEFKQITSGRICDMNGVTYERLRGNTGIQLPCPDVNHPGTPRLFTDRYFPRADGRAALLPREYLPPKETINEIYPFVLITGRQQWHFNTGVRTKRIPYLHQRAPDNFVEIHPHDAAQLRIQNGDEVEVSSSRGTTKGFAQISGRVLQGNIFMPIHYGGAINNKDARLANLVTNNICDIHSKQPEYKFSAVNLKKSQPC

SEQ ID NO: 27741 - protein, 234 aa, Prochlorococcus marinus
MAVVSLSEMMEAGAHFGHQTRRWNPKMSKYIYCARNGVHIIDLVKTALCMNNAYKWTRNAAKSGKRFLFVGTKKQASDVVAQEAVRCGAAYVNQRWLGGMLTNWTTMKARIERLKDLERMESSGAIAMRPKKEAAVLRRELERLQKYLGGLKGMRRLPDVVVLVDQRRESNAVLEARKLDISLVSMLDTNCDPDLCEVPIPCNDDAVRSVQLILGRLADAINEGRKGSNDQRKN

SEQ ID NO: 27742 - protein, 269 aa, Oryza sativa
APSSRRRRRRSCSSSRRRPAAWRTRRSRYLDCQKVGAPPEVAARLTAVAQDLELRQRTALGVLGAATEPELDQFMEAYHEMLVKYREELTRPLQEAMEFLRRVETQLNTLSISGRSLRNILSSGSSEEDQEGSGGETELPEIDAHGVDQELKHHLLKKYSGYLSSLKQELSKKKKKGKLPKDARQQLLNWWELHYKWPYPSESQKVALAESTGLDLKQINNWFINQRKRHWKPSDEMQFVMMDGYHPTNAAAFYMDGHFINDGGLYRLG

SEQ ID NO: 27743 - protein, 300 aa, Candida albicans
MSTTNCRFYENKYPEVDEVVMVNVQEIAEMGAYVKLLEYDNIEGMVLLSELSRRRIRSIQKLIRVGKNEVAVVLRVDKEKGYIDLSKKVVSAEDIVKCDERYNKSKAVHSILRHCAEKFNIPLERLYETIGWPLSRKYGHAYDAFKISITDPSVFDSVDVPSKDVLEELKLYISRRLTPQAINIRADVDVSCFSYEGIDAIKEALKAAESVSTSQMQVKAKLVAAPLYFITVQALDKNEGVKLLEKAIEKITESIEASGGNCKVSMPPKAVSANEDAELERMLQRREAEDKDSSDEEDDA

SEQ ID NO: 27744 - protein, 482 aa, Ashbya gossypii
MAEEIQMMGGMEVGKKLPAAQKGCVPRGNGSRAAYNDFVRKLFAILESGEYTDIISWTKEGNSFVVVDTNEFTTNILPKHFKHSNFSSFVRQLNKYDFHKVKRTPEERQSSVYGEHSWEFQHPRFRRNDEAALDRIKRKTVTQKKVSLTDDMLAGHQRVGNGAVAFPAMDLGATTNLLLNNTINKTKFSQLKKRVDSIELHNQQLRAENNSLKIEFQKMSSRYNSMVENLVSLKNYNNSLVENFNLLVSTLAQQGLKVPHPLNLGNYASSQVAKNSSASDVQPHVSPLGTVAPTSIPLAQATPSKEEANPPTSLRPGFHVLLVEDDSVCIQLCSKFLRKYGCSVEVVTDGLSAIETVEKFQYDLVLMDIVMPNLDGATATSVIRSFDNQTPIIAMTGNIEDQDLVTYLQHGMNDILAKPFTKDDLHSMLVRYLKDRIPLTEQASVVGTAQSGAQPPLLKEEQGGIQDQVLLQGEPLLKKPRV

SEQ ID NO: 27745 - protein, 221 aa, Aspergillus oryzae
MARRPARCYRYCKNKPYPKSRFNRGVPDPKIRIFDLGRKKANVDDFPLCVHMVSNEYEQLSSEALEAARICANKYLVKITGKEGFHMRVRVHPFHVIRINKMLSCAGADRLQTGMRGAFGKPQGTVARVNIGQIILSVRTRDSNRAAAIEALRRSMYKFPGRQKIVVSKNWGFTPVRREDYIQLRNEGKLKQDGAYVQFLRGHGLVENNMKRFPDAYESQA

SEQ ID NO: 27746 - protein, 238 aa, Unknown
  Synechococcus sp. CC9311
MAVVTLAEMMEAGAHFGHQTRRWNPKMSRYIYCARNGVHIIDLVQTAVCMNNAYKWVRSAARSGKRFLFVGTKKQASEVVAQEALRCGSSYVNQRWLGGMLTNWTTMKARIDRLKDLERMESSGAIAMRPKKEGAVLRRELERLQKYLGGLKNMRRIPDVVVLVDQRRETNAVLEARKLDISLVSMLDTNCDPDLCEVPIPCNDDAVRSIQLVLSRLADAINEGRHGGQDGRGDDGQG

SEQ ID NO: 27747 - protein, 305 aa, Unknown
  Halobacterium sp. NRC-1
MELGVVGLGRMGRIVVDRCLDAGHDVVAFDIDATAREDAADAGATPADTLDALAAELGAEKRIWLMVPAGDPVDAALDELAPHLDSDDVVVDGGNSHFEDSTRRAEEHDFAYLDCGTSGGPAGAELGFSLMVGGPEWAYDDLVPVFDAVATGPDGHDRMGPAGAGHYVKMVHNGVEYALMQTYGEGFELLHEGRYDLDLEAVARTWNNGAVIRSWLLELCEEAFREEGSDLGTVADHVAGGSTGTWTVQEALEQEVPVPLVSQALSERFGSRSTGGDTGRFARRLANRLRYGFGRHEVARTGDDA

SEQ ID NO: 27748 - protein, 314 aa, Mycobacterium avium
MKPNLTLEIPDLRGKFAVVTGANSGLGFGLAKRLAAAGAEVVLAVRDPAKGDQAVAAIRRAVPQAKLTIRQLDLSSLRSVAALGEQLTAEGRPIDILINNAGVMAPPRRQQTSDGFELQFGTNHLGHFALTGRLLALLRAADSARVVTVSSIAATQRKLDFADVNAEHGYQPMYSYGVAKLAQLMFAVELDWRSRLGGWGLMSNAAHPGLAKTNLLSGASYGSSAPTLQARLTRLTWRLLPFMWLDIDEAVKPTLYAAVSPDAQGARYYGPRGFYETARGGVTFARVPPLARSEPEMARLWRLSEQLSGVDYPG

SEQ ID NO: 27749 - protein, 918 aa, Escherichia coli
  misc_feature (639)..(639): Xaa can be any naturally occurring amino acid
MTNYSLRARMMILILAPTVLIGLLLSIFFVVHRYNDLQRQLEDAGASIIEPLAVSTEYGMSLQNRESIGQLISVLHRRHSDIVRAISVYDENNRLFVTSNFHLDPSSMQLGSNVPFPRQLTVTRDGDIMILRTPIISESYSPDESPSSDAKNSQNMLGYIALELDLKSVRLQQYKEIFISSVMMLFCIGIALIFGWRLMRDVTGPIRNMVNTVDRIRRGQLDSRVEGFMLGELDMLKNGINSMAMSLAAYHEEMQHNIDQATSDLRETLEQMEIQNVELDLAKKRAQEAARIKSEFLANMSHELRTPLNGVIGFTRLTLKTELTPTQRDHLNTIERSANNLLAIINDVLDFSKLEAGKLILESIPFPLRSTLDEVVTLLAHSSHDKGLELTLNIKSDVPDNVIGDPLRLQQIITNLVGNAIKFTENGNIDILVEKRALSNTKVQIEVQIRDTGIGIPERDQSRLFQAFRQADASISRRHGGTGLGLVITQKLVNEMGGDISFHSQPNRGSTFWFHINLDLNPNIIIEGPSTQCLAGKRLAYVEPNSAAAQCTLDILSETPLEVVYSPTFSALPPAHYDMMLLGIAVTFREPLTMQHERLAKAVSMTDFLMLALPCHAQVNAEKLKQDGIGACLLKPLTXTRLLPALTEFCHHKQNTLLPVTDESKLAMTVMAVDDNPANLKLIGALLEDMVQHVELCDSGHQAVERAKQMPFDLILMDIQMPDMDGIRACELIHQLPHQQQTPVIAVTAHAMAGQKEKLLGAGMSDYLAKPIEEERLHNLLLRYKPGSGISSRVVTPEVNEIVVNPNATLDWQLALRQAAGKTDLARDMLQMLLDFLPEVRNKVEEQLVGENPEGLVDLIHKLHGSCGYSGVPRMKNLCQLIEQQLRSGTKEEDLEPELLELLDEMDNVAREASKILG

SEQ ID NO: 27750 - protein, 276 aa, Corynebacterium efficiens
MAVVTMRELLDAGVHFGHQTRRWNPKMRRFIFTERNGIYIIDLQQTLTYIDQAFEFVKETVAHGGTILFVGTKKQAQEAVQVEAERVGMPYVNHRWLGGMLTNFQTVSKRLHRMKELQAMDAAEDGYEGRTKRETLMLTRERVKLERVLSGIADMSRIPSALWIIDTNKEHIAVAEAHKLNIPVVAILDTNCDPDVVDYPVPGNDDAIRATALLSRVISTAVEEGKKAREERQLAAAREAAGEPKSEDAPAEAAATEEAPATEAPAAEAQQENAAE

SEQ ID NO: 27751 - protein, 510 aa, Unknown
  uncultured sulfate-reducing bacterium
MTSDGETELKTHSQGSLPKAPEEVYLATVTRRINWRRIAFILLGLFLFVTVAVSPPWPDAVDPSGESFALDREGKLALGLFLLAAVWWVFEVVPIGITSIAIGVVQALFLIRPARVAFTDFMDPSVWFIIGSIVIGMVFTKTGLTKRMAYKMLVLVGERTSMIYLGVFVLTALLAHIMAHTAVAATIYPLLMAIYTLYEEDNRQTKFGAGLFMGMAYTAGAGSIITLLGAARGAVALGFYKDVVGREISFFELTYYMFPIGWLMVFVLWGFFMIFCKPEQKRIVGLRERASNLYAKLGPMSKQEIIALTIVLATVVLMSLRSFIPALAGVNKSAIILASTVVFFLFRILEIEDLEDIPWNIILLFGGAMSIGFCLWQTGAAKWLAVQWLVLFEDAPWFVFVMGITFFVLLMTNFIMNVAAIAISLPVALVLAGYLGVAPEVVLFASLVAAGMPFLLLVGAAPNAIAYGSGQFTSGQFFLYGIPASIILMIVIGIFVRFVWPLMDMPILLD

SEQ ID NO: 27752 - protein, 331 aa, Xanthobacter autotrophicus
MEQPDMRLMEPARLVLNPTTTPLLPAPQLSQALGGPQIWIKRDDLIPFGCGGNKIRGLELIVADALKAGADTLVTGAGVLSNHVRATAAAAAFCGLGMTAVYWGDPPRQTRGNHLLSVLWGAQTRFTGSSDRNSVDGMLEVEAADIRAAGGRPYVIPRGGACALGVIGHVQAVGEVMAQCRQAGIRPDYVVMAVGSGGTLAGWLLGSRLLGASWRVEGITVSRPAAEARVRVKDLADQAADHLGLGRAVPADDVIIHDGFIGAGYGIASPAGMSALERAARCEGVVLDPVYTGKAMAGYGALVGAGRYGEAATVLFLHSGGLPSLFVDGTA

SEQ ID NO: 27753 - protein, 421 aa, Brucella melitensis
MTTENLLESALVRLDEAASHINIDADVIEKLKFARETMKVRLMIRMDDGSRKSFIAWRCRYDDTRGPTKGGIRYHPDSTVEEVETPAFWMTFKCAVMNLPYGGGKGAIQVDPRQLSKAELERLSRAYIQAFSGIIGPDRDIPAPDVYTNSMIMGWMADEYSQIVGQSSPAVITGKPIALGGSLGRNDATARGGFYLVRHLSHDLGLASVLRVAIQGFGNAGQFMAKLMAGDGHKIVAVSDSAGAVYCADGLDVDLLLAAKADGKSVISTAGHKGHEAISADELVAADCDVLVPSAMENMIHAGNAASIRAKLIVELANGPVTGDADKILAEKGVMVLPDILANAGGVTVSYFEWVQNRQGYYWTLEEIHERLKTIMEREGRAIWNHARERGVTLRTAAYVHALERLAQAIEAHGTQNDFAA

SEQ ID NO: 27754 - protein, 330 aa, Legionella pneumophila
MTNNRVRVAVTGAAGQIGYALVFRIASGQMFGPNTEVELNLLELEPALPSLEGVAMELDDCAFPLLKRIVCTADLNKAMDGVNWALLVGSVPRKQGMERSDLLQINGGIFTKQGQAINDYASDDVRVFVVGNPCNTNCLIAMNHAKDVPSDRFYAMTTLDELRARTQLAKKAGVDITAVTQMTIWGNHSATQYPDFYNAKINGTSAAQVINDETWLKETFVSTVQQRGAAVIKARGSSSAASAANAIITGVNHLVTDTPAGESFSMCRRSKGEYGVDEGLIFSFPCRREHGELKVVENLEFNDFGRERFNTTLNELRSERDTVKSLGLLD

SEQ ID NO: 27755 - protein, 362 aa, Citrus sinensis
MAPSTLTALAGEKTLNPSFVRFQDERPKVAYNEFSNEIPVISLAGIDDVGGKRAEICKKIVEACEDWGIFQVVDHGVDAKLISDMTRLATEFFALPPEEKLKFDMSGGKKGGFIVSSHLQGEVVKDWREIVTYFSFPKQSRDYSRWPDKPEGWMEVTKEYSDKLMGVACKLLEVLSEAMGLEKEALTKACVDMDQKIVVNYYPKCPQPDLTLGLKRHTDPGTITLLLQDQVGGLQATKDNGKTWITVQPIEGAFVVNLGDHGHYLSNGRFKNADHQAVVNSNSSRLSIATFQNPAPEATVYPLKIREGEKPVLEEPIPFSEMYRRKMSKDLELARLKKLANEKKQYSEKAKLDAKPIEEILA

SEQ ID NO: 27756 - protein, 200 aa, Arabidopsis thaliana
  misc_feature (128)..(128): Xaa can be any naturally occurring amino acid
  misc_feature (164)..(164): Xaa can be any naturally occurring amino acid
  misc_feature (178)..(178): Xaa can be any naturally occurring amino acid
  misc_feature (184)..(184): Xaa can be any naturally occurring amino acid
MASSMLSSATMVASPAQATMVAPFNGLKSSAAFPATRKANNDITSITSNGGRVNCMQVWPPIGKKKFETLSYLPDLTDSELAKEVDYLIRNKWIPCVEFELEHGFCVPVSTVNSPGYYDWTGTGQLWXKVPLVPGCTDSAQSVEGSGRVKKEYPNAFHRIIGFXNTPSVQCISFIAYXPPSFTXKFPFAVGKPQNFIPPS

SEQ ID NO: 27757 - protein, 127 aa, Haloarcula marismortui
MTRIALIAHDDEKPEMIDLAQSYEATLSEFDLVGTGTTSKRIMAETDLTVERKESGPMGGDTQIGAEVAEGRMDGIVFLRDPLTAQPHEPDISALLRICDVHDVPLATTRASAEYILEGLAQDRADD

SEQ ID NO: 27758 - protein, 241 aa, Arabidopsis thaliana
MASQTPNLECRMYEAKYPEVDMAVMIQVKNIADMGAYVSLLEYNNIEGMILFSELSRRRIRSVSSLIKVGRIEPVMVLRVDKEKGYIDLSKRRVSEEDIQTCEERYNKSKLVHSIMRHVAETLSIDLEDLYVNIGWPLYRRHGHAFEAFKILVTDPDSVLGPLTREIKEVGPDGQEVTKVVPAVTEEVKDALVKNIRRRMTPQPMKIRADIELKCFQFDGVVHIKVVSLIRLSLTCEMNTL

SEQ ID NO: 27759 - protein, 112 aa, Unknown
  Frankia sp. EAN1pec
MKLVTAVIKPFKVDDVKTALEGIGVHGLTISEVQGYGRQKGHTEVYRGAEYKVDFVPKIKIEVVVDDEAVDELVTAITTSAQTGKIGDGKVWVVPVDAVVRVRTGERGSDAL

SEQ ID NO: 27760 - protein, 197 aa, Clostridium acetobutylicum
MEEKRTAFIERKTTETSIEVDINLDGEGKYDIDTGIGFFDHMLELMSKHGLIDLKVKVIGDLKVDSHHTVEDTGIVIGECINKALGNKKSINRYGTSFVPMDESLCQVSMDISGRAFLVFDGEFTCEKLGDFQTEMVEEFFRALAFNAGITLHARVIYGKNNHHMIEGLFKAFGRALSEAVSKNTRIKGVMSTKGSI

SEQ ID NO: 27761 - protein, 565 aa, Escherichia coli
MADILPRVNREDVMKIVIVGGVAGGASAAARARRLSEDVSIVVFERGSDVSFANCGLPYHIGGKIPLRQSLILKTPEDFKSRFNIDVRIRHEVMSVDPVNKMVTVKNLTSGEVYTEEWDRLLLSTGAAPVVPPLPGLQEAGVFTLRNLTDMDAIQAWIEQHNIAHTTLVGGGFIGLEVMEALSERGISVTLLEMGEQVMAPVDPEMASALHQEIRSHGVDLRLRTALTEVLRTETGFRVALSDGGFLQTDMVILAIGVKPESSLATGAGLAVGKRGGISVNACMQTSIPDIYAVGDAVETPDLVFQEPANVPLAGPANRQGRIAADNMLDRHSLYHGSQGTSICKVFSLSIGSVGANEKQLKAHGTRYEKVYVHAADHASYYPGATMISLKLLFSPDTGKILGAQASGKKGVDKRIDVLAVVQRAGLTVNDLEHLELTYAPPFNSARDVVNQAGMVAANVIKGDTVICHVRDVLQREPGSYCLLDIRSPAELKQFGEYPDALSIPLDSLRENLDKLPEDKEIIIGCQSGLRGHVAYRMLQSHGFRTYNLSGGFITWQAVTESMSQ

SEQ ID NO: 27762 - protein, 676 aa, Prosthecochloris aestuarii
MDPSQREENSLPLLRYDMLEFRPEWQFDDPDSGAYYHSGVVVNKLFFTSLGGDIQYEVAEKALAFVRKLFSDGVLRDCEYIRIADYSGVSKATINSRILYANTLNKLTEEYNCRPSVTYICGASVLLKTMLRIFSHIVSQRFFFVDSVDEAFRRINAHEMSGCVVSSESLVVTRKEIDEFAALCGHLLFEDTNVKSFSRDYISEDHPLNELYKIIGVLHNDLGELKQKEKDQKKRLEEALFEARSLNQKLIDEKRNVEENERVQQELIDTLKKARVEAESANKAKSEFLANISHEIRTPLHAVIGMTELLLESSLAKDQQYYADTISSSAHLLLLLINDLLDFSRIEAGYIDQEKEDFDMRRLIGDIMSLMKDSASRKRLLLDSRVDERLSFCLTGYPGYLRQVLMNLIQNAVKFTYKGMVSLHVTLLSETPEHVSLEFSVKDTGVGIAEEQLKVIFHRFTQIDASSTRKEGGTGLGLAIVKQLVTFMGGEVSVDSRQGEGSDFRFSLTFDKAGEAKADQSSADLSCRQKDGFRSSRSVDDIIRPHRILLVEDNVINQKVAQAMIEKIGYEIDIAVNGEEAVEALQQKQYGLVLMDLQMPVMDGFEATRRIRKFGGLASNARVPVVAMTANATREDRELCLRAGMDDYLSKPVERQVLLDMLQRWLPFKDEPGVET

SEQ ID NO: 27763 - protein, 318 aa, Aspergillus oryzae
MATDTSTYKLNHTMIRVKDPKKSLEFYKFLGLTQIQQLDFPENKFSLYFLAYNGPKSLQGDRHWTDRNAVLELTHNYGTENDPNYSVANGNTEPHRGFGHIAISVDNIESACKRIEDAGYPFQKKLTDGRMKHIAFAKDPDGYWVELIRRHNEDVGTTTDTANYRLNHSMLRVKCAETSLKFYQEVMGMTLLRTAENKDAGFNLYFLGYPAGNPKVQEDAKNPVAEWEGLLELTWNYGTEKQEGPVYHNGNAEPQGFGHICVAVDDLNAACERFESLNVNWKKRLTDGRMKDVAFVLDPDGYWIEVIQNQALKRTSNW

SEQ ID NO: 27764 - protein, 426 aa, Oryza sativa
MAPEPEDDIMNEKNPRPLDEDDIALLKTYGLGPYSTSIKKVEKEIKEMAKKINDLCGIKESDTGLAPPSQWDLVSDKQMMQEEQPLQVARCTKIISPNTDDAKYVINVKQIAKFVVGLGDKVSPTDIEEGMRVGVDRNKYQIQIPLPPKIDPSVTMMTVEEKPDVTYNDVGGCARGIEKMREVVELPMLHPEKFVKLGIDPPKGVLCYGPPGTGKTLLARAVANRTDACFIRVIGSELVQKYVGEGARMVRELFQMARSKKACIVFFDEVDAIGGARFDDGVGGDNEVQRTMLEIVNQLDGFDARGNIKVLMATNRPDTLDPALLRPGRLDRKVEFGLPDLEGRTQIFKIHTRTMNCERDIRFELLARLCPNSTGADIRSVCTEAGMYAIRARRKTVTEKDFLDAVNKVIKGYQKFSATPKYMVYN

SEQ ID NO: 27765 - protein, 642 aa, Unknown
  Azoarcus sp. BH72
MCGIHGFYRFDGRAVERAHLSAMGDVTRHRGPDDEGQHIEPGGRCGIAMRRLSIIDLAGGHQPISNADDTLWVVCNGEIYNFRELRQELQARGYRFKTGSDSEVLLHLYDLHGDDFVHRLDGMFNFALWDARRQRLLIGRDHLGVKPLYVHQSASLLAFATEAKALLALPGMQPALNREVLGDYLHLGYVPAPHSMFAGIRKLPPATLLSVDAQGVREWRYWRLPQTVDRTVGEAEWVERIRAGMEAAVQRQMVADVPIGAFLSGGVDSSAVVAYMARHSDQPIRTYAIGFEGGEAEQLYNELPYARQVAGLFGTEHREIVVRPDVVGLLPRLLWHMDEPVADSAFITTYLVSEFARRDVKVILSGVGGDELFGGYRRYLGGHYLDKLARLPLWSRRLMARTAGLLPSDRHSKVLNTLRLARGLLASSELAPDDRYRHYLQVLPRDDVAALTRGQPGGSDALAAAFAAAGNDDALNRMFAVDAETQLPDDLLLLTDKMSMAVSLECRVPLLDRALVELAASIPESLKVRNGRLKHLMKSALADVLPPDILDRRKRGFGTPMGAWLKQQLAPVLRRLLAADVVRDRGLFDPAVVARLVADHEAARIDGTDALLALMNLEIWSRVHLDRHSVDDVTAELKSLIA

SEQ ID NO: 27766 - protein, 644 aa, Unknown
  Azoarcus sp. BH72
MCGIAGLFDTRGKRDFDRGLMSRMNDIQHHRGPDEGGYHFEPGVALAHRRLSIIDLATGQQPLFNEDGSVAVVFNGEIYNFQELVPELEALGHVFHTRSDTEVIVHAWEAWGEACVHRFRGMFAFVLHDRQRETLFLARDRLGVKPLFYALLADGTLAFGSELKVLTQHPGLDRRIDPLAVEEYFALGYIAEPRTIFEGARKLGPGESLCIRRGQPVVAPTRYWDVRFTLDNPLSLGDACAELTERLRESVRLRMISEVPLGAFLSGGVDSSAVVATMAALSDAPVNTCSIGFADPRFNESEFARMVAERYRTNHHVETVESDDFDLIDTLAALYDEPYADSSAIPTYRVCQLARKHVTVALSGDGGDESLGGYRRYRLHLMEERMRSALPLGVRQPLFGLLGRLYPKADWAPRVFRAKTTFQALARDAVEAYFHSVSILRRDMRSQLFSASFRAQLGGYDAIEVFRRHAAAAGTDDPLAFIQYLDLKTYLVGDINTKVDRASMAHSLEVREPLMDHPLVEWLATLPSALKMKGGEGKYVFKRAMEPMLPHDVLYRPKMGFSVPLARWFRGPLKQRVREAVLGGTLASTGIFNRPYLEHLLDAHQSGARDYSAPLWTLMMFEAFVRNLDRAAAPVAAGADLALA

SEQ ID NO: 27767 - protein, 455 aa, Unknown
  Candidatus Kuenenia stuttgartiensis
MKKLLLINPVGRRSGYLLSKFSTFPPLGLAYVAAVTPSNWNVKIVDENFDKFVFEEADLVAITAFTTTISRAYEIARMYRERKTKVVMGGIHVSMLPDEALQYADAVLIGEAEGIWERVINDFENNRLSSKYVGVQMDLTTFKTTPRHDLLHPDYFWHSVQTSRGCPFNCYFCSVSKHLGKAYRQRKPQEILNELEEIKGKYITFVDDNLIGYTTESKARAMELFKGMIQRKLHKRWWMQTSINAADDERVIELAAQSGCLYVFIGFETISQGMLKDMKKGINLKIGVENYKKVVDRFHKYGIGVLGAFIIGNDNESSLYYKKLADFLVQSGIDIVQITLLTPLPGTQLMDQLRGEGRLLYQNFPQDWDKYRFSYLVHPPQGVEIDTVYIGNNYIKNRIYSFPTFQFRLMKSFLKLKSMRNFYAIYKSNKAGKKSWLNSHYHQKYPSVFKSDSEF

SEQ ID NO: 27768 - protein, 181 aa, Bacillus licheniformis
MAEKRELATFAGGCFWCMVKPFDEQPGILKVESGYTGGHTENPTYEEVCSNTTGHREAVQITFDPDVFPYEKLLELYWQQIDPTDSGGQFTDRGESYRTAIFYHNDKQRKLAEESKKKLGESGIFKDPIATDILEAGPFYPAEEYHQDYHKKHPERYTQYRIGSGREGFLQQHWGRKHDEQ

SEQ ID NO: 27769 - protein, 342 aa, Saccharomyces cerevisiae
MIKHIVSPFRTNFVGISKSVLSRMIHHKVTIIGSGPAAHTAAIYLARAEMKPTLYEGMMANGIAAGGQLTTTTDIENFPGFPESLSGSELMERMRKQSAKFGTNIITETVSKVDLSSKPFRLWTEFNEDAEPVTTDAIILATGASAKRMHLPGEETYWQQGISACAVCDGAVPIFRNKPLAVIGGGDSACEEAEFLTKYASKVYILVRKDHFRASVIMQRRIEKNPNIIVLFNTVALEAKGDGKLLNMLRIKNTKSNVENDLEVNGLFYAIGHSPATDIVKGQVDEEETGYIKTVPGSSLTSVPGFFAAGDVQDSRYRQAVTSAGSGCIAALDAERYLSAQE

SEQ ID NO: 27770 - protein, 431 aa, Prochlorococcus marinus
MKRVLAIILGGGKGSRLYPLTKMRAKPAVPLAGKYRLIDIPISNCINSGINKMYVLTQFNSASLNRHIGRTYNLSAPFGQGFVEVLAAQQTPDSPKWFEGTADAVRKYQWLFQEWDVDEYLILSGDQLYRMDYSLFVQHHRDNKADLTVAALPVDESQAEGFGLMRTDDLGNIKEFSEKPTGEKLKSMAVDTSKFGLTKESASEKPYLASMGIYVFSRKTLFDLLNKFPSYTDFGKDIIPEALSRGDTLKSYVFDDYWEDIGTIGAFFESNLALTQQPKPPFSFYDEKFPIYTRPRYLPPSKLVDAQITDSIVCEGTILKSCSILHCVLGVRSRIESDSVIEDTLVMGSDFFESLEERIELRKGGGTPLGVGEGSTIKRAILDKNARIGDNVVIVNKDRVEEADKPDVGFYIRNGIVVVVKNATIANGTII

SEQ ID NO: 27771 - protein, 951 aa, Burkholderia thailandensis
MTLDTLAQPIAQPTPGAVRETRSTCCYCGVGCGVVIETRRDANGRDAIVGVRGDSDHPANFGRLCSKGGTLHLTATPERYAQTRATHPELRASRDAARTRVSWDDALDHVAQRLARIVERHGPDAVGFYISGQLLTEDYYVFNKLAKGLVGTNNIDSNSRLCMSSAVVGYKKTLGADAPPCSYEDLDHAGTVLIAGANPAYAHPILYRRLEAARARNPRMKVIVADPRRTDSASDATLHLALQPGTDTMLFNAMLHVLIWDGALDSAFIDAHTQGFDALRDAVRDATPAAAAQVCGLRADDIVQAARWFGAGPSLSLYCQGLNQSASGTAKNVALINLHLATGQIGKPGAGPFSLTGQPNAMGGREVGGMATLASAHRDLANPAERAEIARLWGVPGLPAQPGLTAVEMFEQLAAGALKAIWIVCTNPAHSIPNQALARAGLERAEFVVLQDAYAHTGTAPYADVLLPAATWGEKDGTVTNSERRISRVRAATQPYGDARADWRIAADVGRRLEARLAPGRPTLFPYEDAEAIWKEHRATTVGRDCDIGGLSWPLLARDGPQQWPFPAGAAQGFARLYADGRFPTADGRARFVPTPYQPVAEAVDARYRFALTTGRLRDQWHGGSRTGTVAKLFAHAPQPCVELDPGDCARLELGAHDFVHLTSRRGSALLPARADDAVAPGQAFAPMHWGDEYVSGVAGNRAAMGINALTTPARDPYSQQPELKHAAIKLLKADLPWRWLIAARVPAGDVLARQRAARAFFARFPYASCVPFGTDAYAGLAWRVAAYEPAPAELQREIEALFELPAQAADVMSYGDARRGTGRRVRIVDGALVAFSVAGAAGATEDSAAVLREYVDSGASVGALGRLLLFAGRVPLQTAPARGRTICNCVGVSEREIGAVLAADAPSAAPGERLANLQERLKCGTQCGSCIPELRRLIAETATAAAPSPR

SEQ ID NO: 27772 - protein, 245 aa, Zea mays
MGSEANGGAAAIDLLRSAAPFLPDADLLLTPGTGLVLVDLVNGFCTVGAGNLAPVTPNKQIEKMVEESTRLAKVFCQRNWPVFAFLDTHHPDKPEPPFPPHCIIGSGEENFVPALEWLENDPNVTMRRKDCIDGYLASFEKDGSNVFSEWVAKFQIKTVLVVGICTDFCVLDFVSSTLAARNIGRVPPLEDVVIYSEGCATFDLPVEVARSIKGALAHPQDLMHHMGLYMAKSRGAKIVDGILEE

SEQ ID NO: 27773 - protein, 472 aa, Prochlorococcus marinus
MPKAHFGLIGLGVMGENLVLNAERNGFSSVVFNRTYSKTQEFLEGRGLGKNVEGAKTLQEFVNKLERPRRILMMVKAGAATDAVIDNISEYLEEGDLLIDGGNSQFKDTERRVATLESKSFGYIGMGVSGGAKGALEGPSMMPGGTKASYDAIESLLTKMAAKVEDGPCVAYVGPGGSGHFVKTVHNGIEYGIEQILAEAYDLMKRVKNMNGSQMAEVFGLWNNTDELASYLVEITQICLNTKDELTGEDVVEKILDKAGQKGTGLWTVVSALELGISVPTIYASLNARVMSSLKVQRSEIEKTIPMEAIEDFDLGEISNGMKPLFDAVVLATIASYAQGMDILSEASSVYNYELNMPSIAQIWKGGCIIRSKLLKKIQDAYQKDPNLKNLIFDDWFNNEISTRIDNLASVVSSSTKAGIPVPCLSSTLDYLNSYRTNRLPQNLVQAMRDCFGSHTYERVDKEGSFHTEWMK

SEQ ID NO: 27774 - protein, 362 aa, Corynebacterium diphtheriae
MTETTLRSDTDAVILVGGKGTRLRPLTVSTPKPMLPTAGVPFLSHLLARIKAAGITHVVLGTSFKAEVFEDYFGDGADLGLEIEYVVEDKPLGTGGGIRNVYDKLRANTVMVFNGDVLGGTDLGGILDAHHAKNADLTMHLVRVPDPRAFGCVPTDAEGRVSAFLEKTEDPPTDQINAGCYVFRRELIGEIPADRVVSVERETFPRLLEEGRRVFGYVDNAYWRDMGTPSDFVRGSSDLVRGIAPSPLLEGKTGECLVDESAGVSDGALLLGGTVIGRGTEIGAGCRLDDTVVFDGVTIEPGAVIEDSIIGHGARIGANARITGCVIGEGAEIGARCELRDGMRVWPGVVIPTAGIRFSSDA

SEQ ID NO: 27775 - protein, 243 aa, Unknown
  Frankia sp. EAN1pec
MPRHPIVVVVGVAGRFERTHYPVSQRPALGRVKADKNPAHGNPRMPCTAVQGLALPIPRGSTVLRVTMWRASPSSAPVSRQPKMWSAVPKADYFQDPDAPAANSLTPVVNVAIRDDAGRLLLIRRSDDGYWALPGGFMDCGERIADAAAREVREETGLMVKVTGIVGLYTDPAHVTAFDDGEVHQQCTVCFHATVVGGTPRPTAEAASVDYYAEEQLTALKIHPVMRLRIEHCFTENQPPYIG

SEQ ID NO: 27776 - protein, 404 aa, Haloarcula marismortui
MTDTVDEVDMPYDDDASQQQKIEALQERLEVLESQNEEMRDKLLDANAENNKYQQKLERLTHENKKLKQSPLFVATVQELSSDGVIIKQHGNNQEALTEVTDEMREELEPDDRVAVNNSLSIVKQLDDETDVRARVMQVDQSPDVTFADIGGIEEQMEEVRETVEMPLKSPEMFEDVGIDPPSGVLLHGPPGTGKTMLAKAVANETDATFIKMAGSELVHKFIGEGAKLVRDLFELARQEEPAVVFIDEIDAIAAKRTESKTSGDAEVQRTMMQLLSEMDGFDDRGDIRIIAATNRFDMLDRAILRPGRFDRLIEVPNPDLEGRKQIFQIHTRSMNVADDVDFEALAEDIQDASGADVKAICTEAGMFAIRDDRTEVTMADFHNAWEKIQQEETDDEDVSRTFA

SEQ ID NO: 27777 - protein, 344 aa, Arabidopsis thaliana
MKKNKVPTELIFSLPNDLLVNILARVSRLDYPILSLVSKRFSSVLTLPELYQTRSLVGLTENCLYVCLLSSRADRIPSWFKLCRRPILASDTRKSSGYVLATIPIPHSPPLHRSSLVAVGSNIYNIGGSISQSQSSSVSILDCWSHTWLEGPSMQVEREYPSASLLDGKIYVTGGCRLTFHGCGDQTDNVVVDGKLHSCGGYKGVAYNPNDGRWDSLGSEMNLGLKWSSSCVIENVIYYYYHNENIKWYDTKVRSWRTLNGLKTLPRFARYANVRLADYGGKMALFWDKFTGCGNQNRMIWCAIIALERRNNEEIWGNVEWSDAVLPHQVPMAYVCEYVVAVNV

SEQ ID NO: 27778 - protein, 469 aa, Streptococcus pyogenes
MVSVMWFRRDLRIDDQKALAHAIASQSPTLCVFQFNNEQLNLLHSRNQSSFITSVLAFRKLLKCEGIDLYLMYGDLMTCFEQLLTQLKDWTDVYFNYDESGYGRLRDQKAAQFFKKNGIAVHTYQDHYLHGSQEIINQSGQPYKVFTPYYRIWQNYPKETPIKVELSQGRWLNLETPDDVLRTVESFKDEKYQDVATFDEASKQLNRFIQDQLAAYHANRDFPAQLGTSRLSPFLRIGAIGIRTVYHAVRQAPNSLGQATFLKELAWRDFYNMVYVAYPDQKTQPIQKAFSQIEWVNNPDWFQLWKEGKTGYPIVDAAMLQLQKTGWMHNRLRMIVASFLTKDLLCDWRLGEQYFQQQLIDYDAASNIGGWQWAASTGTDAVPYFRIFNPVTQGKRFDPKGEFIKAYLPQLEHVPEKYLHEPWKMPKYLQESVSCIIGTDYPQPIVDHAKQREQAIAKYEWAKEKAKIE

SEQ ID NO: 27779 - protein, 437 aa, Arabidopsis thaliana
MSLILKFMLLILLVSSHHVRSGSIVKFLPGFKGPLPFELETGYIGIGEEENVQFFYYFIKSDKNPQEDPLIIWLNGGPGCSCLSGLFFENGPLALKNKVYNGSVPSLVSTTYSWTKTANIIFLDQPVGSGFSYSKTPIERTSDTSEVKKIHEFLQKWLIKHPQFLSNPFYVVGDSYSGMIVPALVHEISKGNYICCNPPINLQGYVLGNPITHIEFEQNFRIPYAHGMSLISDELYESLKRICKGNYFSVDPSNKKCLKLVEEYHKCTDNINSHHTLIANCDDSNTQHISPDCYYYPYHLVECWANNESVREALHVDKGSIGEWIRDHRGIPYKSDIRSSIPYHMNNSINGYRSLIFSGDHDITMPFQATQAWIKSLNYSIIDDWRPWMIKGQIAGYTRTYSNKMTFATVKGGGHTAEYLPEESSIMFQRWISGQPL

SEQ ID NO: 27780 - protein, 134 aa, Bacteroides fragilis
MEKYIYELTLKVRDYECDLQGIVNNANYQHYLEHTRHEFLSSVGVSFAKLHEEGVDPVVARINMAFKTPLKSGDEFVSKLYMKKEGIKYVFYQDIFRKSDDKVVVKSTVETVCVVNGRLSDSELFDQIFAPYLQ

SEQ ID NO: 27781 - protein, 317 aa, Unknown
  Oceanobacter sp. RED65
MSTRHIKLLILGSGPAGYTAAVYAARANLNPVVITGMQMGGQLTTTTDVDNWPGDVDGLQGPELMQRMQAHAERFNTEVLFDHINNVDLSKKPYTLTGDQGTYTCDALIIATGASAQYLGLESEEAFKGKGVSACATCDGFFYKGKEVCVIGGGNTAVEEALYLSNIAAKVHVIHRRDSFRSEKILADKLLEKAKNGNVEIHWFNELDEVLGDEMGVTGVRLKNNQTGEKQEIELAGVFVAIGHIPNTDIFQGQLDMENGYIKVQSGSHGNATLTSKEGVYAAGDVMDHVYRQAITSAGTGCMAALDAERYLDELEK

SEQ ID NO: 27782 - protein, 517 aa, Schizosaccharomyces pombe
MLNGMNPIEMEHIPFSSTPTGEFDLDPDMANEKLLEVEEKNIYLLAKSYFDCKEFERAAYTLQNCKSSKSIFLRLYSKYLAGEKKSEEENETLLNTNLTLSSTNREFYYISEVLESLHYQGNKDPYLLYLSGVVYRKRKQDSKAIDFLKSCVLKAPFFWSAWLELSLSIDSLETLTTVVSQLPSTHIMTKIFYVYASHELHQVNSSAYEKLAEAEIIFPNSRYLKTQRALLTYDSRDFDEAESLFENILTNDPYRLDDMDTYSNVLFVLENKSKLGFLAQVASSIDKFRPETCSIIGNYYSLLSEHEKAVTYFKRALQLNRNYLSAWTLMGHEYVELKNTHAAIESYRLAVDVNRKDYRAWYGLGQTYEVLDMHFYALYYFQRATALRPYDQRMWQALGNCYEKIDRPQEAIKSYKRALLGSQTNSSILVRLGNLYEELQDLNSAASMYKQCIKTEETEISPETIKARIWLARWELGKKNYREAELYLSEVLNGDLELEEAKALLRELRSRMEHSYD

SEQ ID NO: 27783 - protein, 191 aa, Sinorhizobium meliloti
MFFLANGETRMPVVRGKNIEVLYSAETIAARNQEMAADIVRGPHKDLLVISILKGSFIFAADLIRAMHAAGLAPEVEFITLSSYGTGTESKGVRITKDIDSDVRDRDVLLIDDILESGRTLRFAKELLLERGARNVTIAVLLDKRVKRRVDLEADYVGFECPDHFVVGYGMDVAYAFRELPFVGVVTGDAT

SEQ ID NO: 27784 - protein, 505 aa, Oryza sativa
MEAFVPGGAGVAAAAVGGFVAAAALAERAGVIAPRKRPNAPPAVPGLPIIGNLHQLKEKKPHQTFAKWAEIYGPIYTIRTGASSVVVLNSTEVAKEAMVAKFSSISTRKLSKALTVLTRDKSMVATSDYCDFHKMVKRYVMSSMLGTSAQKQFRDIRDMMIHNMLSTFHKLVKDDPHAPLIFRDVFKDELFRLSMIQSLGEDVSSVYVDEFGRDISREEIYNATVTDMMMCAIEVDWRDFFPYLSWVPNKSFETRVFTTETRRTAVMRALIKQQKERIVRGEAKTCYLDFLLAENTLTDEQLMMLVWEALIEAADTTLVTTEWAMYELAKNPDKQERLYQEIREVCGDETVTEEHLPRLPYLNAVFHETLRRHSPVPLIPPRFVHEDTKLAGYDVPAGTEMVINLYGCNMNRKEWESPEEWVPERFAGGRLEVADMYKTMAFGAGRRACAGSLQATHIACAAVARFVQEFGWRLREGDEEKVDTVQLTAYKLHPLHVHLTRRGRM

SEQ ID NO: 27785 - protein, 652 aa, Oryza sativa
MVKIKMPALFRRRSGSKSPPLPQADPASGGGSPAPTPEEEMERVFRKFDANGDGRISRSELGALFESLGHAATDDELARMMAEADADGDGFISLDEFAALNATASGDAAAVEEDLRHAFRVFDADGNGTISAAELARVLHGLGEKATVQQCRRMIEGVDQNGDGLISFEEFKLSHLPEPEYTSAVLGMARSYVIFCQNWGESMSSGGVGGGSLGAGLPYHKFVSFALEETRLRTTLTPHPSQYLSELCRPIVAASFNHVSKPCLRLSIFLSHVNEKFKSIKPNDDNTVFNALSFSAPKIRLLRSLTIEKKNSYQVLDFAAFSEPEYDLPIFCANVFTTHAQSIVVLDLNPLYDTTVHKDYKDKYYRSIMPLVHKYNEVWLELMDQAIKENNKATIARNQEEQHKYLTWRAEKDPGYPLLKKLIGESRAEDLVMEFLFEGVNTLGTKSFLDYFPEYARDDGSVNKKRSMMGKSFETRPWDANGEFIGDAEAHRHDLKQEGSSCPARIRILCSLLHHAFVTDMWAERSSGPPVREKVTFWEIIKPQLARQGNIKEVVIRALPETKEQKVGNCVALQNCKGETANPGLDLPAGEARRRQGKTSVTGTIVVWPELTCGEVAELVYGFNLNQTLLQAANHNPGVRIHCTVKRFLKHR

SEQ ID NO: 27786 - protein, 128 aa, Triticum aestivum
MEGQVVEMTEAEQAAHQAQLEQQLKSFWAKQLVEMEQLEVGSEQDFKNHNDLPLARIKRIMKSDEDVRMISAEAPVLFAKACEMFILELTLRSWSYSERNKRRTLQKEDIQAAIRNTDIFDFLVDVIN

SEQ ID NO: 27787 - protein, 618 aa, Candida glabrata
MKHYKLYLLLAGVYAETVVGPLDEDLPSMEPVADPELSPVTEEMFSSWALFILLFLLISALWSSYYLSRRRIRAVHETVLSIFYGMVVGLIIRMSPGHYIQDTVTFNSSYFFNVLLPPIILNSGYELNQVNFFSNIVSILTFAIPGTLISAVVLGTILFIWTSLGLEGVNISFLDALSVGATLSATDPVTILSIFNAYKVDPKLYTIIFGESLLNDAISIVMFETCQKFHGQPAKFSSLFAGAGLFLMTFSVSLLIGVLIGMLVALILKHTHIRRYPQIESCLILLIAYESYFFSNGCHMSGIVSLLFCGITLKHYAYYNMSRRTQVTVKYIFQLLARLSENFIFIYLGLALFTEVELVYKPLLIIVTAISICVARWCAVFPLSNFVNWIYRVRTLHSIRPSVGESIAVPDEIPYNYQVMTFWAGLRGAVGVALAMGLQGEFKFTLLATVLVVVVLTVVIFGGTTAGMLEVMNIKTGCVDNGDPEEDEFDIENVGEDPLDDEPLQFNANSRNLMRPYTDLPTPVGNVRDFDENDFPSMSATPDRMSEQAASSQRPSGERTNLKDAIGNMLRTDSQWFQNFDEQVLKPVFLDSTSSPMTNRDEGLNSNRDSPRFMSSRK

SEQ ID NO: 27788 - protein, 169 aa, Triticum aestivum
MAPTVMASSATAVAPFQGLKSTATLPVARRSTTSFAKVSNGGRIRCMQVWPAYGNKKFETLSYLPPLTEEQLLKQVDYLLRNNWVPCLEFSKEGFVYRENSTSPCYYDGRYWTMWKLPMFGCTDASQVYKELQEAIASYPDAYVRILGFDNIKQTQCVSFIAYKPAGSE

SEQ ID NO: 27789 - protein, 194 aa, Haloarcula marismortui
MVELVGLAAGATLTLIVVALHYAKGTGWEAPEDISQEVLEQRAATVPETDFAEPYNRSIGGGGAVAIPAGEAEGELGEGEAVEEEDEGFDPDDIADDEVEYYEIEFAKEGETIEVANNETILDAGEEEGWDLPYACREGQCISCAGHIEDGPATDHIRHSNNDSLMDDDMEEGYCLTCVAYPTSEFTIETGESP

SEQ ID NO: 27790 - protein, 283 aa, Clostridium perfringens
MELWYTEEHTDKVRFSIKVDEQLYSGKSDFQRIDVFKSQEFGTFFTLDGLMMVTEKDEFIYHDMIVHVPMATNPNIKNVLVIGAGDGGTVRELTRYETIEKIDMVEIDKLVVDVCREYLPQTANKLDDPRVSLFFEDGLKFVRSVENKYDLIIVDSTDPFGPGEGLFTREFYGNCFKALKEDGILVNQHESPYYEEYARGMKRAHKRIKECFPVCRVYQAHIPTYPSGHWLFGFASKKYDPLNADIEKWNDLGLKTKYYNTDLHKGCFALPNYVKEMLENVDE

SEQ ID NO: 27791 - protein, 299 aa, Haloarcula marismortui
MELGVIGLGRMGRIVVDRVLEAGHEVVVFDIDEESVADAADAGARPASSIADLAGKLGSEKRIWLMVPAGDPVDAALDELAPTLDSDDVVVDGGNSYFEDSVRRAESTDAAYLDCGTSGGPAGADLGFSLMVGGPEWAYDELVPVFDAVATGPDGHDRMGPAGSGHYVKMIHNGVEYALMQTYGEGFELLANGRYDLDLESVANTWNNGAVIRSWLLELCEEAFREEGNDLGDVADRVEGGSTGTWTVQEALEQEVPVPLIYQSLAERFGSRADDGRFARRLASRLRYGFGRHEVPRRE

SEQ ID NO: 27792 - protein, 112 aa, Unknown
  Polaromonas sp. JS666
MKLVTAIIKPFKLDEVREALSGIGVQGITVTEVKGFGRQKGHTELYRGAEYVVDFLPKVKIEAAVSDDLVDRVIEAVEGAARTGKIGDGKVFVYNLEQVVRIRTGETGKEAL

SEQ ID NO: 27793 - protein, 507 aa, Unknown
  Fragaria x ananassa
MDSWCVTLKPNTHLRQPTQAGLCCGANGFLGQRIRESFGNRGWVHGSEKTRPGVVSSVVTTKDFETTLKVPTYHRPRVDPKNVASIILGGGAFTQLFPLTRRAATPAVPVGGCYRLIDIPMSNCINSNINKIFVLTQFNSTSLNRHLARTYFGNGINFGDGFVEVLAATQTSGEAGMDWFQGTADAVRQFVWVFEDAKNRNVENILILSGDHLYRMDYMDFVQSHVDSNADITLSCAVVGDSRASDYGLVKIDSRGKIIQFAEKPRGAGLKAMQSDTTLLGFSPQDALKSPYVASMGVYVFKTDILLELLKKSYPNSNDFGSEIIPAAVEERNVQAYIFIDYWEDIGTIQSFYDANLALTEEFPKFQFYDPKTPFFTSPRFLPPTKIDNSRVVDAIISHGCFLQECFVQSSIVGERSRLDYGVELKDSIMMGADSYQTESEIAALLARGKVPIGIGRNTKIRLCIVDLNAKIGKDVIIMNKDGIQEADRPEEGFYIREESLSLWRRE

SEQ ID NO: 27794 - protein, 322 aa, Bacillus licheniformis
MKKMKRIGVLTSGGDSPGMNAAVRAVVRKAIYHDVEVYGIYNGYSGLISGKIEKLEIGSVGDIIHRGGTKLYTARCPEFKTVEGREKGIANLKKYGIEGLVVIGGDGSYMGAKKLTEHGFPCVGVPGTIDNDIPGTDLTIGFDTALNTVIDAIDKIRDTATSHERTYVIEVMGRHAGDIALWSGLAGGAESILIPEADYDMEEIIARLKRGHERGKKHSIIIVAEGVGSGVEFGKRIEEATNLETRVSVLGHIQRGGSPTAADRVLASRLGAFAVELLLEGKGGRCVGIQNNQLVHHDIIEILEQKHTIDQSMYRLSQELSI

SEQ ID NO: 27795 - protein, 75 aa, Triticum monococcum
DINFNLSDYEEDLKQMRNWTKEEFVHILRRQSTGFARGSSKYRGVTLHKCGRWEARMGQLLGKKYIYLGLFDSEV

SEQ ID NO: 27796 - protein, 885 aa, Medicago truncatula
MPTWWGKSSSKETKKKAGKESIIDTLHRKFKFPSEGKRSTISGGSRRRSNDTISEKGDRSPSESRSPSPSKVARCQSFAERPHAQPLPLPDLHPSSLGRVDSEISISAKSRLEKPSKPSLFLPLPKPSCIRCGPTPADLDGDMVNASVFSDCSADSDEPADSRNRSPLATDSETGTRTAAGSPSSLVLKDQSSAVSQPNLREVKKTANILSNHTPSTSPKRKPLRHHVPNLQVPPHGVFYSGPDSSLSSPSRSPLRAFGTDQVLNSAFWAGKPYPEINFVGSGHCSSPGSGHNSGHNSMGGDMSGPLFWQPSRGSPEYSPIPSPRMTSPGPSSRIQSGAVTPIHPRAGGTPTESQTGRADDGKQQSHRLPLPPLTVTNTSPFSHSNSAATSPSMPRSPARADSPMSSGSRWKKGKLLGRGTFGHVYIGFNSQSGEMCAMKEVTLFSDDAKSLESAKQLMQVDDKLYIYLEYVSGGSIHKLLQEYGQFGELAIRSYTQQILSGLAYLHAKNTLHRDIKGANILVDPNGRVKVADFGMAKHITGQYCPLSFKGSPYWMAPEVLLFLFWVIKNSKECSLGVDIWSLGCTVLEMATTKPPWSQYEGVAAMFKIGNSKELPTIPDHLSNEGKDFVRKCLQRNPRDRPSASELLDHPFVKGAAPLERPIMVPEASDPITGITHGTKALGIGQGRNLSALDSDKLLVHSSRVLKNNPHESEIHIQRNISCPVSPIGSPLLRSRSPQQRSGRLSPSPISSPRTASGASTPLTGGSGAIPFSNHLKQSVYFQECLGSMPKSPNGVYINGSSHHDSNIDIFQRMQAGSHIKSELVSSDNDALGKQFVRSPHAEPYDFQSVLADRVGRQLLGDHVKINPSFDPSPSSSMLNRTNGL

SEQ ID NO: 27797 - protein, 656 aa, Arabidopsis thaliana
MSSLICFIFLFLFSFITSFTASAQNPFYLYHNCSITTTYSSNSTYSTNLKTLLSSLSSRNASYSTGFQNATAGQAPDMVTGLFLCRGNVSPEVCRSCIALSVNESLSRCPNEREAVFYYEQCMLRYSNRNILSTLNTDGGVFMQNARNPISVKQDRFRDLVLNPMNLAAIEAARSIKRFAVTKFDLNALQSLYGMVQCTPDLTEQDCLDCLQQSINQVTYDKIGGRTFLPSCTSRYDNYEFYNEFNVGKGGNSSVIVIAVVVPITVLFLLFVAFFSVRRAKRKKTIGAIPLFKVKRKETEVTEPPAETTDGDDITTAGSLQFDFKAIVAATDIFLPINKLGQGGFGEVYKGTFPSGVQVAVKRLSKNSGQGEKEFENEVVVVAKLQHRNLVKLLGYCLEGEEKILVYEFVPNKSLDYFLFDPTMQGQLDWSRRYKIIGGIARGILYLHQDSRLTIIHRDLKAGNILLDADMNPKVADFGMARIFGMDQTEANTRRVVGTYGYMAPEYAMYGKFSMKSDVYSFGVLVLEIVSGMKNSSLDQMDGSISNLVTYTWRLWSNGSPSELVDPSFGDNYQTSEITRCIHIALLCVQEDANDRPTMSAIVQMLTTSSIALAVPRPPGFFLRSKQEQAERACPSMDTSDLFSIDEASITSVAPR

SEQ ID NO: 27798 - protein, 341 aa, Unknown
  Bradyrhizobium sp. BTAi1
MRPSRTSDVRQWPVGHFTSGYAALALRRKAQSGAFCLARANLANATETRALTTDDDSKVRIACIQMQPMVGELATNLAHSLDLIKQAVAMGAKLVVLPELASSGYVFKSREEAFAASETIPGGPAVTAWSEIAAKHGLHLVAGICERDGTKLYNSAVLIGPKGYIGSFRKVHLWNEENLYFEPGNLGFPVYHTEIGRIGMAICYDGWFPESYRLNALQGADIVCVPTNWVPIPGQAEGREAMANILAMAAAHSNSIFIACADRVGVERGQPFEGQSLIVSYTGWPVAGPASRDKEEIVIADVALGEARRARNWNAFNQVLRDRRSDVYDEMLGSDVKRGWY

SEQ ID NO: 27799 - protein, 398 aa, Roseovarius nubinhibens
MLLRAIDRFFSHEASGGILLMLATVAALLAANSGFQQGYEAFLSAKLSVTVNGEGLNKPLILWINDGLMAIFFFLIGLELKREMLEGKLKNPRDIVLPGVAALGGMALPAVIFAALNWGEATVAGWAIPAATDIAFALGILALVGRRAPVALKVFLLTLAILDDLGAIIIIALFYTAELKIDYLLFALVPLAGLIWLNMKGAHRVAPALLLGALMWVLVLKSGVHATLAGVVTALCIPLTDKWGKSPLHALEHGLAPYVLYLIVPVFAFANAGVVFEGITAQMMLAPLPLGVALGLVIGKQAGVFGLSFLAVKTGLARLPHGVRWIHVYGVACLAGVGFTMSLFIGALSFADPILMNQVRIGVLTGSAISAILGFTVLMLARGEEPKVAVKDSAPDFP

SEQ ID NO: 27800 - protein, 457 aa, Coccidioides immitis
MSLTESSPSEIAKLASSVSRQLGALPVVSRNDALTAIHTALYQNKDAILQANARDIEVATKAVNEGTLSQSILKRLDLSRPGKYDDMLQGILDVRSLEDPLGNVSLRTLLDDGLVLERVSCPIGVLLIIFEARPEVIANITALAIKSGNAAILKGGKESIESFREIARIVSKALLSTDVPNTAIQLVESRDVILPLLAQDKCIDLVIPRGSNELVRFIKANTKIPVLGHADGLCSIYLRSDADITMAKKIILDAKLNYPAACNAVETLLVDEDALCTLLPSIAEALLQNGVSLRCDRKSKSALVASLSPSQAALLQDSMESDYDTEFLDLILAIKTVSASPSLSSLDAAMAHINAHSSKHTDVIITSSKETAEQFLIGIDSAGVYWNTSSRLADGMRYGFGTEVGISTNKIHSRGPVGLEGLTIYKYLIRGNGHTAGEFQGEAGKQWKHQQLPLGDR

SEQ ID NO: 27801 - protein, 391 aa, Triticum aestivum
MYGVTTHASVQLMRAELQVLSPLVPIREVTFLRFCKQHADGLWAIVDVSVDGVLRPDSGTGAGPAGYMGCRLLPSGCIVEDMQNGYAKVTWVVHAEYDEAAVHELYRPLLRSGQALGARRWLASLQRQCEYHAILCSNPHPNHGDRHEAISPAGRRCMLRLAQRMADNFCAGVCATAAQKWRRLDEWRVEGAGGRDPAGGEDKVRMMARQSVGAPGEPPGVVLSATTSVRLPGTLPQRVFDYLRDEQRRGEWDILANGEAMQEMDHIAQGQHHGNAVSLLRPNATSGNQKHMLILQETCTDASGSLVVYAPVDVQSMHVVMGGGDSAYVSLLPSGFASSRRAHKPATGMPSSQGRPHGHAGGEQNPGRSYRGFKSRKTARGNYRGWRTPNR

SEQ ID NO: 27802 - protein, 388 aa, Salinibacter ruber
MPRDYYDILGVDEDASDKEIKKAYRKKAMEYHPDRNPDDPEAEQKFKEASEAYEVLSDPEKRQRYDQFGHDGVDSGAGGGRRGRGRGFHDIEDIFDAFSDIFGGAPGGGRGRGRSERGRGRPGSDLRVSLSLTLEEIAEGTEKNLRLQKYLECESCDGTGAEGGMGGQNFSMCPKCDGTGEIRQVSRSVFGQVVNVQPCPRCEGEGRIIDNLCDDCGGEGRVQGEESISINVPPGVMEGNYLTLGDAGNAGLRGGPSGDLRIEIEEEPHEHFERDGLDIYYDLHLSFPEAALGTEVDVPTLEGEARLEVDPGVQAGKILRMRDRGLPDLEGSGQGDQMIRVHVWTPQELTAEEEELLDQLRAHDNFQPRPPEEDTQKSFFRRVSDVFS

SEQ ID NO: 27803 - protein, 429 aa, Agrobacterium tumefaciens
MSNTDAFFSRPLAEVDPDIFGAIEKELGRQRHEIELIASENIVSRAVLEAQGSIMTNKYAEGYPGKRYYGGCQFVDIAEELAIERAKKLFGVNFANVQPNSGSQMNQAVFLALLQPGDTFMGLDLNSGGHLTHGSPVNMSGKWFNVVSYGVREGDNLLDMDEVERKAKETRPKLILAGGTAYSRVWDWKRFREIADEVGAYLMVDMAHIAGLVAGGQHPSPFPHCHVATTTTHKSLRGPRGGMILTNDEDLAKKFNSAVFPGLQGGPLMHVIAAKAVAFGEALQPEFKDYAAQVVKNAKALAETLIEGGLDVVSGGTDNHLMLVDLRKKNATGKRAEAALGRAYITCNKNGIPFDPEKPFVTSGVRLGTPAGTTRGFKEAEFREIGKLIVEVLDGLKVANSDEGNASVEAAVREKVVGLTDRFPMYPYM

SEQ ID NO: 27804 - protein, 350 aa, Borrelia hermsii
MKISIVGAGAWGTAISKVLADKFKDNVFIWSFEEDVRDSINNDHENVKYLKDIKLPDNLIASSDLLDVVSQSDYVFVATPSLYTLNVFNKLKSMYATKKFNLAILTKGFITIDGKPCPIVEVAESVLREYKDEITYIAGPSHAEEVGLGVITGLVAASKNRANAFEFIDLFSATSISMFYSDDVLGVQIASALKNIFAIAFGILDEIKIKDPNLIGNNTESFLFSVSLNDMRNIAFKLGACNEGTFLFLAGSGDLDVTCRSIFGRNRRFGREIISKNILEGLTDIDDLINNIHKIGYLPEGIVASKEVSVLLKYLGNNSNEHNLVNIVYKILNKELKPEAVVDYIRNFKF

SEQ ID NO: 27805 - protein, 315 aa, Bacteroides fragilis
MGKIAKKLTDLVGNTPLLELSNYNASNGLKARVVAKLEYFNPAGSVKDRISLAMVEDAEAKGTLKSGATIIEPTSGNTGVGLAFVAAAKGYKLILTMPDTMSMERRNLLKALGAELVLTPGANGMKGAIAKAEELRAATPGSVILQQFENPANPAVHVRTTGQEIWRDTDGKVDIFVAGVGTGGTVSGVGAALKEHNPAVRIVAVEPVDSPVLSGGVPGPHKIQGIGAGFIPKTYHAAVVDEIRQVGNDDAIRTSRELAAKEGLLVGISSGAAVYAATELAKLPENEGKLIVVLLPDTGERYLSTILYAFEEYPL

SEQ ID NO: 27806 - protein, 181 aa, Thermoanaerobacter tengcongensis
MPSPMEDIEEILITEEQLKAKVKELGEMITRDYEGKDLVLIGVLKGAIMFMSDLSRAIDLPLSIDFMAVSSYGSSTKSSGIVKIIKDHDIDIEGKDVLIVEDIIDSGLTLAYLRETLLGRKPRSLKICTILDKPERREADVKVDYCGFKIPDKFVVGYGLDYAEKYRNLPFIGVLKPELYK

SEQ ID NO: 27807 - protein, 259 aa, Arabidopsis thaliana
  misc_feature (86)..(86): Xaa can be any naturally occurring amino acid
MAMAVSGAVLSGLGSSFLTGGKRGATALASGVGTGAQRVGRKTLIVAAAAAQPKKSWIPAVKGGGNFLDPEWLDGSLPGDFGFDPXLGLGKDPAFLKWYREAELIHGRWAMAAVLGIFVGQAWSGVAWFEAGAQPDAIAPFSFGSLLGTQLLLMGWVESKRWVDFFNPDSQSVEWATPWSKTAENFANYTGDQGYPGGRFFDPLGLAGKNRDGVYEPDFEKLERLKLAEIKHSRLAMVAMLIFYFEAGQGKTPLGALGL

SEQ ID NO: 27808 - protein, 296 aa, Unknown
  Rhizobium sp. USDA 1953
  misc_feature (16)..(16): Xaa can be any naturally occurring amino acid
  misc_feature (169)..(169): Xaa can be any naturally occurring amino acid
RGKTQIKEFDAFPTLXQLPLWGFDGSSTQQAEGRSSDCVLKPVAVYPDPVRTNGALVMCEVMMPDGKTPHPSNTRATVLDDESAWFGFEQEYFFYKNGRPLGFPEQGYPAPQGPYYTGVGYKNVGDIARQIVEEHLDICLAAGINHEGINAEVAKGQWEFQVFGKGSKXAADEVWLARYLLLRLTEKYGIDVEFHCKPLGDTDWNGSGMHANFSTAYLREVGGKDYFEALMAAFEKNLHDHINVYGPDNHLRLTGKHETAPWDKFRYGVADRGASIRVPHSFVNNGYRGYLEDRRP

SEQ ID NO: 27809 - protein, 297 aa, Unknown
  Rhizobium sp. USDA 1955
  misc_feature (131)..(131): Xaa can be any naturally occurring amino acid
RGKTQIKEFDAFPTLEQLPLWGFDGSSTLQAEGRSSDCVLKPVAVYPDPVRTNGALVMCEVMMPDGKTPHASNTRATVLDDESAWFGFEQEYFFYKNGRPLGFPEQGYPAPQGPYYTGVGYKNVGDFARQXVEEHLDICLAAGINHEGINAEVAKGQWEFQIFGKGSKKAADEVWLARYLLLRLTEKYGIDVEFHCKPLGDTDWNGSGMHANFSTAYLREVGGQDYFEALMAAFEKNLHDHINVYGPDNHLRLTGKHETAPWDKFSYGVADRGASIRVPHSFVNNGYRGYLEDRRPN

SEQ ID NO: 27810 - protein, 297 aa, Unknown
  Rhizobium sp. USDA 1970
RGKTQIKEFDAFPTLEQLPLWGFDGSSTQQAEGRSSDCVLKPVAVYPDPVRTNGALVMCEVMMPDGKTPHPSNTRATVLDDESAWFGFEQEYFFYKNGRPLGFPEQGYPAPQGPYYTGVGYKNVGDIARQIVEEHLDICLAAGINHEGINAEVAKGQWEFQVFGKGSKNAADEVWLARYLLLRLTEKYGIDVEFHCKPLGDTDWNGSGMHANFSTAYLREVGGKDYFEALMAAFEKNLHDHINVYGPDNHLRLTGKHETAPWDKFSYGVADRGASIRVPHSFVNNGYRGYLEDRRPN

SEQ ID NO: 27811 - protein, 295 aa, Unknown
  Rhizobium sp. CC2129
RGKTQIKEFDAFPTLEQLPLWGFDGSSTQQAEGRSSDCVLKPVAVYPDPVRTNGALVMCEVMMPDGKTPHPSNTRATVLDDEGAWFGFEQEYFFYKNGRPLGFPEQGYPAPQGPYYTGVGYKNVGDIARRIVEEHLDICLAAGINHEGINAEVAKGQWEFQVFGKGSKKAADEVWLARYLLLRLTEKYGIDVEFHCKPLGDTDWNGSGMHANFSTAYMREVGGKDYFEALMAAFEKNLHDHINVYGPDNHLRLTGKHETAPWDKFSYGVADRGASIRVPHSFVNNGYRGYLEDRR

SEQ ID NO: 27812 - protein, 548 aa, Salmonella typhimurium
MEIFFTILIMTLVVSLSGVFTRVLPFQLPLPLMQIAVGALLAWPTFGLHVEFDPELFLVLFIPPLLFADGWKTPTREFLEHGREIFGLALALVLVTVVGIGFLIYWLVPGIPLIPAFALAAVLSPTDAVALSGIVGEGRIPKKIMGILQGEALMNDASGLVSLKFAVAVAMGTMVFTVGGATLEFFKVAIGGILAGFVVSWLYGRSLRFLSRWGGDEPATQIVLLFLLPFASYLIAEHIGVSGILAAVAAGMTITRSGVMRRAPLAMRLRANSTWAMLEFVFNGMVFLLLGLQLPGILESSLAAAEADPNVETWMLFTDIVLIYAALMLVRFGWLWTMKKFSLRFLKKKPMEFASWTSREILIASFAGVRGAITLAGVLSIPLLLPDGSGFPARYELVFLAAGVILFSLFVGVIMLPLLLQHLEVADHAQQLKEERIARAATAEVAIVAIQKMEERLAADTEENIDNQLLTEVSSRVIGNLRRRADGRNDVESSIQEENLERRFRLAALRSERAELYHLRATREISNETLQKLLHDLDLMEALLIENQ

SEQ ID NO: 27813 - protein, 485 aa, Desulfitobacterium hafniense
MDNLDPVVKEQNDIVVKVQNDTKTKVYALIGAIILGILVWFLGEGLGPQGRMALALTMTAIVLWIFEVYPVEITAVLLSTFFVFTGSATPVEAFSGYGDAIVWFIFAALVFGTAVEQSGIGKRIACSLMRFSGTSFKSMMGIIVLVGALLSFLTPAGVERLLIIYPIAIGVAAVFVKGNVQGTNTGKLAMSITYLAGNTFGFGILTGIAVNILGAGIIKEMLGIEIFWSQWILWFGVPTVITTLIAIFVAWKLFPPEDYVLTAKKENANQDFMNLGPMTIVEKRALLYLVITLGLWATDRWHHLPSWGVAIFSAALFCAPGFGVISKEQLKKIQFPIVIFSGAAITIGTVLGKTGVAAWIGKVFLGSFIRPDMSTQLMGAITYLVGVVAHIPLVESKTAAAAFTPAVAAYFDSMQLPALGPTLMSIMSADTVAFFPYMMMPFLALMGLGYFTTKDSIKLLSSYTFVAIIVQVISCFTWYHWVGLL

SEQ ID NO: 27814 - protein, 244 aa, Oryza sativa
MAYARGGKEESWNFVFAGAATSGFLRLRQGAVTAGRDALWSAAFFALAEGASLAIHRALDDLPPADGRRGLAARAPVGRPRRLPASPGFPGQLIVVKEVAVADNEDDSGFSDGFFAEERHATWAARCGLYGAFKCALSLPRATDGDPVVSVLAAGAAGAAHCLRRGPLAVGRGALVGAASMAVIERADAALDNLRSWVHYHRRLVPEEDIDGGGGSDPKPDDEPPIGFLGVPPKPVVVEEVPAG

SEQ ID NO: 27815 - protein, 555 aa, Clostridium perfringens
MKDFKKSVVYQIYPKSFKDSNGDGLGDLRGVIEKLDYLKTLGVDYIWMTPFYVSPQKDNGYDIADYYKIDPRYGTMEDFEELVKEAKSRNIDIMLDMVFNHTSTEHEWFKRALKGEEKYKNYYIFKEGKKGEPPTNWISKFGGNAWEYVEELGEYYLHLFDVSQADLNWDNKELREEIYKVVNFWIDKGVKGFRLDVINLISKPEKFENDYEGDGRRFYTDGHRIHEYLKELNERTFGKDVEIVTVGEMSSTTIENCIKYSNPKEKELSMVFNFHHLKVDYKDGQKWSLMDFDFIELKKLFNNWQRGMIKGGGWNAVFWCNHDQPRVNSRFGDVKKYFNESSKMLATSIHMMSGTPYVYQGEEIGMTNPGFESIEEYRDVESINYFNILKEEGIDKKEIMEILKSKSRDNSRTPVQWNEEKNAGFTTGTPWINIANNYREINVERALENKDSVFYHYKKLIELRKNEDVIAYGDYIPLLEDHPKVYAYERNYNGEKLLVINNFYGEECLVDLSKEIEGLENYNKSILISNYKDSTLDLLNLKLRPYESIVYKLEK

SEQ ID NO: 27816 - protein, 292 aa, Unknown
  Rhizobium sp. CC2155
RGKTQIKEFDAFPTLEQLPLWGFDGSSTQQAEGRSSDCVLKPVAVYPDPVRTNGALVMCEVMMPDGKTPHPSNTRATVLDDEGAWFGFEQEYFFYKNGRPLGFPEQGYPAPQGPYYTGVGYKNVGDIARRIVEEHLDICLAAGINHEGINAEVAKGQWEFQVFGKGSKKAADEVWLARYLLLRLTEKYGIDVEFHCKPLGDTDWNGSGMHANFSTAYMREVGGKDYFEALMAAFEKNLHDHINVYGPDNHLRLTGKHETAPWDKFSYGVADRGASIRVPHSFVNNGYRRYVE

SEQ ID NO: 27817 - protein, 170 aa, Oryza sativa
MASSATSVAPFQGLKSTAGLPVSRRSTNSGFGNVSNGGRIKCMQVWPIEGIKKFETLSYLPPLTVEDLLKQIEYLLRSKWVPCLEFSKVGFVYRENHRSPGYYDGRYWTMWKLPMFGCTDATQVLKELEEAKKAYPDAFVRIIGFDNVRQVQLISFIAYKPPGCEESGGN

SEQ ID NO: 27818 - protein, 282 aa, Arabidopsis thaliana
MGRQPCCDKVGLKKGPWTAEEDRKLINFILTNGQCCWRAVPKLSGLLRCGKSCRLRWTNYLRPDLKRGLLSDYEEKMVIDLHSQLGNRWSKIASHLPGRTDNEIKNHWNTHIKKKLRKMGIDPLTHKPLSIVEKEDEEPLKKLQNNTVPFQETMERPLENNIKNISRLEESLGDDQFMEINLEYGVEDVPLIETESLDLICSNSTMSSSTSTSSHSSNDSSFLKDLQFPEFEWSDYGNSNNDNNNGVDNIIENNMMSLWEISDFSSLDLLLNDESSSTFGLF

SEQ ID NO: 27819 - protein, 887 aa, Arabidopsis thaliana
MAKSSADDEELRRACEAAIEGTKQSIVMSIRVAKSRGVWGKSGKLGRQMAKPRVLALSVKSKGPRKKAILRVMKYSSGGVLEPAKMYDLKHLSKVEVITSDPSGCTFTLGFDNLRSQSVAPPQWTMRNTDDRNRLLVCILNICKDVLGRLPKVVGIDIVEMALWAKDNTPVVTTQRSTEDGEPVAESVTESALKVTVEKELVSQAEEEDMEALLGTYVIGIGEAEAFSERLKRELQALEAANVHAILESEPLVDEVLNGLEAATNIVDDMDEWLGIFNIKLRHMREDIESIEIRNNKLEMQSVNNKALIEELDKVIERLRVPSEYAASLTGGSFDEADMLQNIEACEWLAKALRGLEVPNLDPIYANMRAVKEKRAELEKLKATFVRRASEFLRDYFASLVDFKFSDKSYFSQRGQLKRPDHADLRYKCRTYARLMQHLKGLNKNCLGPLRKAYCSSLNLLLRREAREFAKELRASTKVSRNPTVWLEGSTGSSQNANTDTSAVSDAYAKMLTIFIPLLVDESSFFAHFMCFEVPALAPPGGAGNDKKSQSNNDDGNDNDDLGIMDIDEADKKPGKNSPDLTALNESLQDLLDGIQEDFYAVVDWAYKIDPLRSISMHGITERYLSGQKADAAGFVRLLLGDLESRISMQFSHFVDEACHQIEKNERNVRQMGVLPYIPRFAALATRMEQYIQGQSRNLVDQAYTKFVSILFVTLEKIAQQDPKYADILLLENYAAFQTCLFDLANVVPTLAKFYDQAMEAYEQACTRHISMIIYYQFERLFLFDKKIKDLMYTITPEEIPFQLGLSKVELRKMLKSSLSGVDKSIAAMYKKLQKNLASEELLPSLWDKCKKEFLDKYESFVQLVAKVYPSENVPGVTEMRGLLASM

SEQ ID NO: 27820 - protein, 397 aa, Oryza sativa
MSNPESNPPPPSATSCPPPGSAAHAGHAPLCRSCGAPTTTPVPPPWSASSDSPPPAYRPIRMPAINAPTNTAAIVLSPVPQPLPVPPASPPFAFQVPAKRITSPDDIARFHASVHGRHFLGFVAALSASVHGRKLSDPLPSPPSPVVSALLELISALSAFVASTPPLPHNSRYGNPAFRLWHEKLSDSANQLIAPIMATAGSPDLAGAEAELAPYLLDSFGNATRIDYGTGHETNFAAFLYCLARLGLITEADYPAVVLRVFAAYLDLMRTLQDTYLLEPAGSHGVWGLDDYHFLPFIFGAAQLIDHKYMKPKSIHNPDILDNFSKEYMYLACVAYVKKVKKGPFAEHSPMLDDISGVPHWKKVNSGLLKMYKAEVLEKVPIMQHFLFGSLIKWYGS

SEQ ID NO: 27821 - protein, 463 aa, Pseudomonas putida
MQTHKNNLSHGLKSRHVTMLSIAGVIGAGLFVGSGRAIAEAGPATILAYILAGGLVVLVMRMLAEMAVASPDTGSFSTYADLAIGKWAGYTIGWLYWWFWVLIIPIEANIAATIINSWVPQLEIWVLSLVITLLLTATNLFSVKNYGEFEFWLALVKVVAIVSFIALGVCAIFGLLPGAGVSGVSRLWDTGGFMPNGFGAVLSAMLITMFSFLGAEVVTIAAAESDEAGKHISKATNSVIWRITLFYILSIFIVIALVPWTDPRLATEGSYVTVLDTLGVPNAKAIIDFVVLTSVTSCLNSSLYTASRMVYSLSRRGDAPACAQITSRSGTPVVAVLLSTGAAFLAVIANYLVPAKVFGFLMASSGAIALLVYLVIAISQLRLRQRLTAQGKTLGYRMWLFPWLTWGVILFISGVLVLMLFRPDHRLEVVSTMVLAVLVVCSGVLVTRRRARGGAVAGVGQGA

SEQ ID NO: 27822 - protein, 360 aa, Prochlorococcus marinus
MKKWVVKIGTSILRGNEDQSTEQVIESLCKSLTSFIFKGNKVILVTSGAVGLGCKKLNLNTRPKELSALQAVAAVGQVNLMTLYEKTMKKLGHNIAQILITKTDFDSRESFNNASKTFQKLIDLNVIPIVNENDSIANEELKYGDNDTLSALVALAINANKLILLTDIENLYSKDPRNNEDAHPIKEVNSNQLKIIKDKNIQNYNNEWGTGGITTKLIAAEIATKGGVEVQLADGRNENNLINIFNEKKIGTIFHPVDKPVGNKKSWLSHAIKTVGQITLDEGACLAIEQKGASLLVVGVKEVEGDFTVNQAVRIVNTNKKEVAKGITSMSSDSLKRILNKKENINSSMIVVHRDVLALT

SEQ ID NO: 27823 - protein, 963 aa, Arabidopsis thaliana
MPHRTTYFFPRQFPDRGFDSFSLKNDHDKKKSSSNVGESFGFQRDNKSNGVGEDSNKEKESTVFSSNPLLSKSSAVSDLFSDDRKSEKKHQQQLAAFYEWLAEKKANLSRSSSTTTTHGRGVKPTRFSMSSDADEERELLLSSPADPAPLPATSSPDSIIDSARTVNIHERNIDRSFDREVSLPRMSSESSFAGSFFSGTTVDGNFSNFSSHTDARETSTTTLVSVNKEEEEVEVREQGKEQSLAQKSREGYYLQVTLAKWLSSQANLACESVHIQSTESISYRFWVSGCLSYSDKISDGFYSILGMDPYLWLMCNNSEDGKRIPSLLLLKETEPNDTSMEVVLIDRREDSRLKELEDKAHELYCSSDNMLVLVEKLGRLVAVYMGGNFQVEQGDLQKRWKLVSNRLKEFRKCIILPIGSLTMGLCRHRAILFKKLADYIGLPCRIARGCRYCKESHQSSCLVKIDDDRKLSREYVVDLIGEPGNVHDPDSSINGETQCQIPSPLQMSHLTDFSRPCVHSTSPCQTVESKTSRTLSENIQRSGSQGQVHKEFELPDNAGTVCCAHIDQTCCAKVSSMVLTESVLRALPLDIPNLSEEKIAPQETCKEETVLLEDPTAMKQPNLSVEPEIVEADTRKDKKGRLPVDAISPYLTIEPSLASDWLEVSWNELHIKERVGAGSFGTVHRAEWHGSDVAVKILSIQDFHDDQFREFLREVCKQAVAIMKRVRHPNVVLFMGAVTERPRLSIITEYLPRGSLFRLIHRPASGELLDQRRRLRMALDVVCAIPHYAKGLNYLHCLNPPVVHWDLKSPNLLVDKNWTVKVCDFGLSRFKANTFIPSKSVAGTPEWMAPEFLRGEPTNEKSDVYSFGVVLWELITLQQPWNGLSPAQVVGAVAFQNRRLIIPPNTSPVLVSLMEACWADEPSQRPAFGSIVDTLKKLLKSPVQLIQMGGDKGVIPTKSAPIL

SEQ ID NO: 27824 - protein, 240 aa, Kluyveromyces lactis
MATTASEYGNELSKVPIQHQFNPYSDNGGTILGIAGEDFAVLAGDTRHTTDYSINSRYEPKVFECEDNILISANGFAADGEALVKRFKNSQMWYHFNHNKKLTIKSAARNIQHLLYGKRMFPYYVHTIIAGLDEEGKGAVYSFDPVGSYEREQCRAGGSAASLIMPFLDNQVNLKNQYEPDSNGTKRKEVKYLGVEEVIKLVRDAFTSATERHINVGDGLEILIVTKDGVRKEYFDLKRD

SEQ ID NO: 27825 - protein, 427 aa, Unknown
  uncultured sulfate-reducing bacterium
MKVLLIDLSPFTEAVTPVSLGYIGAALAGSGHEVKVISIGQSSMVSLSGLERFLGEFQPALVGFGTYQRNLPHIIALARLIKQNLPGASIVLGGPHASLMPDEGLAALPDVDFLCRGEGEAAIEAIAEAVLSGDASQAVPGATRRTSDGGIVTGPAIEPARDLDRYPSPWLSGILDPASMSESIMLASRGCPHSCVFCYTPAAFDRRIQYNSIDRVLEEIAYVAERGTGRLWFADPNFSFSEKRVIGILEGILSRNLEVEMWVETRADMLTAELIRLMKRAGVYLVAMGLESASPNVYPGLNKNLQPEEIREAARLALEAGLDVELFSQFALPNEKLEDAMATLQFVKDCGVKIQGNSNAQQMQLYFGSEICADSARYGVIPLRESFPPYLSIGTEFETRWLSKREIDEIKGAWRAESLDGGKRVVS

SEQ ID NO: 27826 - protein, 371 aa, Unknown
  Methylovorus sp. SS1
MAKKDYYEVLGVNRDASDEEIKKSYRKLAMKYHPDRNPDNPKAEESFKEAKEAYEVLSDEQKRAAYDQYGHAGVDPSAGPGPRQGFGNFADAFGDIFGDIFGGGGGNRRSNVYRGADLRYNMEISLEDAARRTETKIRIPVMSECETCHGSGARPGTQPVTCTTCGGHGQVRMQQGFFSVQQTCPKCHGSGKMVKEPCPSCQGAGRVKKHKTLSVKIPAGVDEGDRIRLSGEGERVNGGPPRDLYVVVHLKQHDIFQRDGGNLHCEMPISFTTAALGGEIEIPTLDGHAKMKIPPETQTGATFRLRGKGIKPLRTNDPGDLMCHVVVETPIKLTERQKELLREMEEINLQDSDKHSPRAKGWMDKVKDFFQ

SEQ ID NO: 27827 - protein, 114 aa, Zea mays
RVLHRRLLNSSPARHEWRRTGGRDHIGLEHHPSGMLDARYMFWPCVFMLCNFGRHPSSVKLPLRVDVLFTHIQKMMTGDSVVMAEPGDSWFSRHKLKLPEGYGYEFQTQYGLIG

SEQ ID NO: 27828 - protein, 611 aa, Rhodobacter sphaeroides
MRIVFVHPNYHSGGAEIAGSWPPAWVAYLCGALKKAGYTDYHFIDAMTDYVSHEKLAEKLRELQPDIVATTAITPSIYVAEETLKVAMEVVPNALRVLGGIHATFMFRQVLEEAPWIDVIVRGEGEEVLVNLVKAYEADNFAETRRQVKGLAFLDGDEIVSTAAAPTIRDVDSIDPDWGIINWKNYIYEPLGVRVAIPNMARGCPFTCSFCSQWKFWRDYRVRDPKKVVDEIEKLVNEHGVGFFILADEEPTMNRKKFIEFCEEMIARGLPDKVKWGINTRVTDVKRDKELLKFYRKAGLVHISLGTEAAAQLKLDVFNKETTVAENKEAIRLLREADIFTEAQFIVGLDNETKETLEETYRMAWDWQPDLANWSMYTPWPFTPLFQELRDQVEVFDYSKYNFVTPIMKPKALTRGELLDGVMNNYRRFYMKKALFHYPWRGTGFRRRYLLGCLKAFLKAGVGRTFYDLGKAGYWGPQSKDKVDFHFDETRKIGNAQMADWEASADRAAKAAERREAARAGQGPCRGAQCGQGRGAPILTAGGGGCGGHADGSDCGCGGKKQQQVDEFHVPMACGSGRQQMAEDEFAMPMACGGGKQQMEEAEERLVRPAE

SEQ ID NO: 27829 - protein, 628 aa, Arabidopsis thaliana
MMFNEMGMCGNMDFFSSGSLGEVDFCPVPQAEPDSIVEDDYTDDEIDVDELERRMWRDKMRLKRLKEQDKGKEGVDAAKQRQSQEQARRKKMSRAQDGILKYMLKMMEVCKAQGFVYGIIPENGKPVTGASDNLREWWKDKVRFDRNGPAAITKYQAENNIPGIHEGNNPIGPTPHTLQELQDTTLGSLLSALMQHCDPPQRRFPLEKGVPPPWWPNGKEDWWPQLGLPKDQGPAPYKKPHDLKKAWKVGVLTAVIKHMFPDIAKIRKLVRQSKCLQDKMTAKESATWLAIINQEESLARELYPESCPPLSLSGGSCSLLMNDCSQYDVEGFEKESHYEVEELKPEKVMNSSNFGMVAKMHDFPVKEEVPAGNSEFMRKRKPNRDLNTIMDRTVFTCENLGCAHSEISRGFLDRNSRDNHQLACPHRDSRLPYGAAPSRFHVNEVKPVVGFPQPRPVNSVAQPIDLTGIVPEDGQKMISELMSMYDRNVQSNQTSMVMENQSVSLLQPTVHNHQEHLQFPGNMVEGSFFEDLNIPNRANNNNSSNNQTFFQGNNNNNNVFKFDTADHNNFEAAHNNNNNSSGNRFQLVFDSTPFDMASFDYRDDMSMPGVVGTMDGMQQKQQDVSIWF

SEQ ID NO: 27830 - protein, 109 aa, Desulfitobacterium hafniense
MAGENVKTFTTANWNEEVLGSDKAVLVDFWAAWCGPCRMVAPIIEELADEMAGKVIIGKLNVDEEPAIAGQYQVMSIPTLAVFKNGQVVDKSVGFRGKADLVKMIEKHA

SEQ ID NO: 27831 - protein, 1014 aa, Ralstonia solanacearum
MKRMLFNATQQEELRVAIVDGQKLIDIDIETAGREQRKGNIYKGVITRIEPSLEACFVNYGEERHGFLPFKEVARAYFKNGVDVRTARIQDALAEGQELIVQVEKEERGNKGAALTTFISLAGRYLVLMPNNPRGGGVSRRIEGEDRQELRETMAQLQVPEGMSIIARTAGIGRSAEELQWDLNYLMQLWKAVDGAAVENKAPLLIYLESSLVIRAIRDYFQPDIGEILIDTDDIYDQARAFMSVVMPDNMNRVKKYRDDVPLFSRFQIEHQIESAYSRMVMLPSGGAIVIDHTEALVAVDVNSARATKGADIEETALRTNLEAADEIARQLRLRDLGGLIVIDFIDMESSKAQKDVETRLKDALRHDRARVQMGKISRFGLMELSRQRLRPSLSEGSHVTCPRCNGTGHIRDTESSALQVLRIIQEEAMKENTAAIHCQVPVEVAAFLLNEKRPDINLIETRFKVNVLLIPNKHLETPHYKLERLRHDDPRLDDNKASYKMAEEAAKELEADTAYSTRKEAAKPRQEAAVKGITPEQPAPVSVPRSERPARAEATPAAPQAAAPVPAQGGFVSWLKSLFGGKPAEPVVAAPVETPKRAEDGNRRDRGNRQDRGGRTGQRGERGERQGQQQAGRDGQRQGQGRDGGRNEAREGQAQREGQREGQRGGRDRNRQPAETAERETVEARQPQQGQEAREGQGRRERSQERRERAPREGREGREPREGREPRESRDNREGRERDTQQAKEGASAAAATAVEGLIDPTAAAQVPQTLLDTTVPAEAITAEVAAPDAEGSGEGEERRRRGRRGRNRYRRDREGAEGVRTEGEGESEGEGETAAGEPAVETPPAVEAAQPAAPVQHETVAAPVQPVETPAPVETAAPVVQEPVQAAEAVKPAPTLPAAQPAEPVAAVVAATPPTETAADTIVTALAEVPAPVASTVAKAPALPIGTLQAVVADAGMTWVHTDEQKLQAAKEDAARTVTPPRVPRERKPLPPIQQGPMVLVETSRPTDGADQ

SEQ ID NO: 27832 - protein, 296 aa, Unknown
  Rhizobium sp. CC2160
RGKTQIKEFDAFPTLEQLPLWGFDGSSTQQAEGRSSDCVLKPVAVYPDPVRTNGALVMCEVMMPDGKTPHPSNTRATVLDDESAWFGFEQEYFFYKNGRPLGFPEQGYPAPQGPYYTGVGYKNVGDIARRIVEEHLDICLAAGINHEGINAEVAKGQWEFQVFGKGSKKAADEVWLARYLLLRLTEKYGIDVEFHCKPLGDTDWNGSGMHANFSTAYMREVGGKDYFEALMAAFEKNLHDHINVYGPDNHLRLTGKHETAPWDKFSYGVADRGASIRVPHSFVNNGYRGYLEDRRP

SEQ ID NO: 27833 - protein, 212 aa, Triticum aestivum
  misc_feature (16)..(16): Xaa can be any naturally occurring amino acid
EKYKKSKQVHSILRHXAEKNDIALKTLYETIGWPLYKKYGHAYDAFKMAILDTDAIFSGIDISKELLDELLSIIKRRMTPQPVKIRAQLDIRCTGIDGVNAIKNALKAGEQVGDEDVPVKITYLAAPFYVVTVDSLDKEQGFQIIEKAIEAIKTTLDQHSWTRFKVEKEAKVVSDSDDRDFAALLAQAEKENELVSGDEDEGDGVAASEDDI

SEQ ID NO: 27834 - protein, 354 aa, Phaseolus lunatus
MAVSAIGFEGYEKRLEICFSQPGIFADPEGRGLRVLTKSQLDEILTPAACTIVSSLSNEDVDSYVLSESSLFVYAYKIIIKTCGTTKLLLSIPPILKFADMLSLTVRSVTYTRGSFIFPGAQPHPHCSFTEEVAILNDYFGKLGSGSMAYIMGSPDKKQKWHIYSASADPLISSDTNVCTLEMCMTGLDREKAQIFYKEQSASAAIMTVNSGIRKILPKSDICDFDFEPCGYSMNSVEGDAVSTIHITPEDGFSYASFETVGYDFKVLNLNAMVDRVLSCFLPNEFSVAVRVDGASKPSEHMCFVDVKGYCREEWCHEELGMGGFVVYQKFVKISDCVSPRSTLKCWKDEVEEE

SEQ ID NO: 27835 - protein, 291 aa, Unknown
  Rhizobium sp. USDA 1079
  misc_feature (266)..(266): Xaa can be any naturally occurring amino acid
RGKTQIKEFDAFPTLEQLPLWGFDGSSTQQAEGRSSDCVLKPVAVYPDPVRTNGALVMCEVMMPDGKTPHPSNTRATVLDDESAWFGFEQEYFFYKNGRPLGFPEQGYPAPQGPYYTGVGYKNVGDIARQIVEEHLDICLAAGINHEGINAEVAKGQWEFQVFGKGSKKAADEVWLARYLLLRLTEKYGIDVEFHCKPLGDTDWNGSGMHANFSTAYLREVGGKDYFEALMAAFEKNLHDHINVYGPDNHLRLTGKHETAPWDKFXYGVADRGASIRVPHSFVNNGYRGYL

SEQ ID NO: 27836 - protein, 478 aa, Salmonella typhimurium
MARKTLRARRFFSLIFPFFFITSVYAEQTPESAKTVTVEAKNEMFAPQHPDQYQSWKATSEQSAREDALAEDPRLVILWAGYPFSRDYNKPRGHAYAVTDVRETLRTGAPKTAEDGPLPMACWSCKSPDVARLIQQEGEDGYFHGKWARGGPEIVNDLGCADCHNTASDDFAQGKPALTLSRPYAERAMEAIGKPFDKAGRFDQQSMVCGQCHVEYYFDGKNKAVKFPWDEGMKVENMEQYYDTIAFSDWTNSLSKTPMLKAQHPEYETWSAGIHGKNNVTCIDCHMPKVQNAEGKLYTDHKIGNPFDNFAQTCANCHTQDKASLQKVVAERKQAIHDLKIKVEDQLVHAHFEAKAAWDAGATDAEMKPILNDIRHAQWRWDLAIASHGIHMHAPEEGLRMLGSAMDKAADARTKLARLLATKGITHEIPLPDISTKEKAQKAIGLNMQQINAEKQDFLKTVVPQWEDQARKNGLLSQ

SEQ ID NO: 27837 - protein, 251 aa, Synechococcus elongatus
MGAGPGDPGLLTLRGKALLEAAEVVVYDALVSDAILSLINPKADKIHAGKRRGQHSLLQTETTQLLIEKAQQQAVVVRLKGGDPFVFGRGGEEMADLQAAGIAVEVVPGVTAGVAVPAYAGIPITHRDRSSSVTFVTGHEMAGKYRPSIAWEAIARGSETIVIYMGLHNLALIIEQLQTAGLPGITPIALIRWGTRPEQEELFATLETVVAAVAERQFQAPAIAVIGQVVSLSPLLPPTMMTASDRGLPTA

SEQ ID NO: 27838 - protein, 468 aa, Burkholderia thailandensis
MQKGSAETDLHRGLGQRQMRLIALGAAIGVGLFLGSANAIKMAGPGIILSYIIGGAVIFVIMRALGEMAVHEPVAGSFSRYARNYLGPLAGYLTGWNYWFLWLVTCIAEITAVGIYMGIWFPDVPRWIWALAALATMGSVNLLTVKAYGEFEFWFALIKVVTIVVMIAVGIAMIALGIGNHGVPMGISNLWAHGGFFPNGAQGVLMSMQMVMFAYLGVEMIGLTAGEAENPQKTIPGAINSVFWRILLFYGGALFVILSIYPWNEIGTQGSPFVMTFERLGIKTAAGIINFVVLTAALSSCNGGIFSTGRMLYNLAQQGHAPRTFGETTASGVPRRAILVSMAALLVGVLLNYLVPEKVFVWVTSISTFGAIWTWGVILVAQMKFRASLAPAQERALRFRMPFWPYGSWVALTFLVLVVGLMAYFPDTRIALYVGPAWLVLLVVLYYALKLEPEGGKEAGLARGYERG

SEQ ID NO: 27839 - protein, 276 aa, Mycobacterium avium
MAVVTMKQLLDSGTHFGHQTRRWNPKMKRFIFTDRNGIYIIDLQQTLTFIDKAYEFVKETVAHGGTVLFVGTKKQAQESIAAEATRVGMPYVNQRWLGGMLTNFSTVHKRLQRLKELEAMEQTGGFEGRTKKEILGLTREKNKLERSLGGIRDMSKVPSAIWVVDTNKEHIAVGEARKLGIPVIAILDTNCDPDEVDYPIPGNDDAIRSAALLTKVIASAVAEGLQARAGVGRGDGKPEVEAAEPLAEWEQELLASATATAAPTEAGAPEPTTDPS

SEQ ID NO: 27840 - protein, 287 aa, Unknown
  Rhizobium sp. USDA 1083
  misc_feature (5)..(5): Xaa can be any naturally occurring amino acid
  misc_feature (24)..(24): Xaa can be any naturally occurring amino acid
  misc_feature (180)..(180): Xaa can be any naturally occurring amino acid
  misc_feature (194)..(194): Xaa can be any naturally occurring amino acid
  misc_feature (282)..(282): Xaa can be any naturally occurring amino acid
  misc_feature (285)..(285): Xaa can be any naturally occurring amino acid
RGKTXIKEFDSFPTLEQLPLWGFXGSSTHQAEGRSSDCVLKPVAVYPDPVRTNGALVMCEVMMPDGKTPHPSNTRATVLDDESTWFGFEHEYFFYKNGRPLGFPEQGYPAPQGPYYTGVGYKNVGDIARQIVEEHLDICLAAGINHEGINAEVAKGQWEFQVFGKGSKKAADEVWLARYXLLRLTEKYGIDVEXHCKPLGDTDWNGSGMHANFSTAYLREVGGKDYFEALMAAFEKNLHDHINVYGPDNHLRLTGKHETAPWDKFSYGVADRGASIRVPHSXVNXRY

SEQ ID NO: 27841 - protein, 246 aa, Synechococcus elongatus
MFGLFGKKTGLPTPEEALPGRAQAMLVPAKHFVLGTPLDGPFPVGIQLALFGNGCFWGTEKQFWQLPGVYSTAVGYAGGLTPNPNYREVCSGMTGHNEVVRVAYDPDRISYADLLKAFWESHDPTQGMGQGPDRGTQYRSGIYCYTPEQKQIALASQAAYQAVLKAKGYGAITTEIIDAPTFYFAEEYHQQYLDKPGSRPYCGAQPTGADLPHPNQWNLPTELQSHLTAHPEVWSKNFAECPVVPL

SEQ ID NO: 27842 - protein, 296 aa, Unknown
  Rhizobium sp. USDA 1088
  misc_feature (266)..(266): Xaa can be any naturally occurring amino acid
RGKTQIKEFDAFPTLEQLPLWGFDGSSTQQAEGRSSDCVLKPVAVYPDPVRTNGALVMCEVMMPDGKTPHPSNTRATVLDDESAWFGFEQEYFFYKNGRPLGFPEQGYPAPQGPYYTGVGYKNVGDIARQIVEEHLDICLAAGINHEGINAEVAKGQWEFQVFGKGSKKAADEVWLARYLLLRLTEKYGIDVEFHCKPFGDTDWNGSGMHANFSTAYLREVGGKDYFEALMAAFEKNLHDHINVYGPDNHLRLTGKHETAPWDKFXYGVADRGASIRVPHSFVNNGYRGYLEDRRP

SEQ ID NO: 27843 - protein, 417 aa, Pseudomonas syringae
MFSRDLTIAKYDADLFAAMEQEALRQEEHIELIASENYTSPAVMEAQGSALTNKYAEGYPGKRYYGGCEYVDVIEQLAIDRAKELFGADYANVQPHAGSQANSAVYLALLQGGDTILGMSLAHGGHLTHGASVSSSGKLYNAVQYGIDANGMIDYDEVERLAVEHKPKMIVAGFSAYSQILDFPRFRAIADKVGAYLFVDMAHVAGLVAAGVYPNPVPFADVVTTTTHKTLRGPRGGLILARANAEIEKKLNSAVFPGSQGGPLEHVIAAKAVCFKEALQPEFKTYQQQVVKNAKAMAGVFIERGFDVVSGGTENHLFLLSLIKQDISGKDADAALGRAFITVNKNSVPNDPRSPFVTSGLRFGTPAVTTRGFKEAECKELAGWICDILADLNNEAVIDAVREKVKAICAKLPVYGA

SEQ ID NO: 27844 - protein, 310 aa, Bacillus clausii
MRVVDNIADLIGQTPLVRLNKLPDSEGASVYLKLEMNNPSGSVKDRAAFSMIIQAEKDGHLQPGSTIIEPTSGNTGIGLAMNAAARGYRAILVMPDTMSQERINLLKAYGAEVVLTEGDKKMPGAIEKAKELAESIPGSFMPMQFENEANPDAHRRTTAIEIKQDLDAIGATLSGFVAASGTGGTITGTGEVLKTYYPDALIHVVEPAGSPVLSGGKPGPHKLVGTSPGFVPPILNTAIYDQIRRIEDEDAYKTAKDLARLEGILVGPSSGAACFAALEMAKTLDKGDHVVAIACDTGERYLSTDLYQSE

SEQ ID NO: 27845 - protein, 230 aa, Candida glabrata
MNQIPTALNEEVPLFENSSSSQDKETLEGVADVYSIIVALDYVEKAYLRDSISSTHYTQSVNKLLAQYKTYMSMPDISEYVGDLHDFKEKYNIIASNAITRLERGIPVTVEHAIDIDTNNDGSNGSLESKSQGGKYNAKNVAEATGNFITIMDALKLDYKAKDQLHPLMAELLLSINRVTNHDFENRSKLVEWIVKINKMKVEETLDEHEVRELLFILNQAYKSFYSLLG

SEQ ID NO: 27846 - protein, 962 aa, Unknown
  marine gamma proteobacterium HTCC2207
MENIKMLQKTRSLTDLENAAEFIARHIGPSADDQQKMLSSLGCSSLQELTSQVVPEAIAMTQALDIVDGCSEAQALAELREIAAHNKVFRSFIGQGYYNTITPNVVQRNILENPAWYTAYTPYQPEISQGRLEALINFQTMITDLTGMEMSNASMLDEGTAAAEAMSLCQRMSKSKSLRFFVDSDCLPQTIDVIKTRAEPVGIEVIVGNPDQLPEDLFGALFQYPGASGEVRNFRDVIQQVQQQGALVVMAADILSLVLLESPGSLGADVVIGSTQRFGVPLGFGGPHAAYMSTREAYKRNLPGRLVGLSQDANGEPAYRLALQTREQHIRREKATSNICTAQVLLAVIAGMYAVYHGPEGLQRIARRVNLMTSVLAQGLALHGIKPINNHWFDTLTLDTGARTEEILQVAAAHEVNLRRIDENTLGVSLDETVTRSDINLLWTILIGEHQIDIDDLADQAVDSLPGELMRTESFLTHPTFNRYHSETEMLRYLRKLSDKDIALDRAMIPLGSCTMKLNATAEMLPITWPEFSTMHPFAPTDQTQGYRLMIDQLEDMLCASTGYDAMSLQPNAGSQGEYAGLLAIRGYHESRGDTDRDICLIPSSAHGTNPASAQMCGMKVVVVKCDDQGNVDVDDLIAKAELHSAKLSAIMVTYPSTHGVFEERIGEICEIVHDHGGQVYIDGANLNAMVGVCQPGKFGGDVSHLNLHKTFCIPHGGGGPGVGPIGVGAHLAPFMPRETADGERQGAKVSAAPYGSASILPITWMYIRMMGRSGLKQATEMAILNANYIATRLQDDYEILYTGAQGRIAHECILDVRSIKDDVGISVDDIAKRLIDFGFHAPTMSFPVAGTLMIEPTESESKAEIDRFCDAMIAIKHEINQVAAGQLDLADNPLVHAPHTAEVVGADEWTRSYSRSQAAYPLRSLRENKYWPPVGRLDHVFGDRNLICSCPSISDYETDEV

SEQ ID NO: 27847 - protein, 986 aa, Oryza sativa
MAVASASALFSAKNLPHKPWEDPSFFRWRKREAHVPLRSHDTPEGALKYWHERRNVNYLNSDSAVWNDDAVRGALEIPSNWQMHGFDRPIYTNVTYPFTMNPPFVPNDNPTGCYRTVFRIPKEWKGRRILLHFEAVDSAFFAWVNGVPVGYSQDSRLPAEFEITDFCHPCDSEKENVLAVQVMRWSDGSYLEDQDHWWLSGIHRDVLLVSKPQIFITDYFFKATLDEGFRVADIEHDSANTGIVYKVANLFFACRFLSILLGQNINHSQNKSKIGLAIPLLQKDREHVSTLSIEATLYDNYGPADVLTSDMSAASVANLKLKPASRPKHCYGFHGYVLGGKVENPKLWSSEHPNLYTLVVVLKDSNGKLIECESCQVGIRNVVLAHKQMLVNGCPVVIRGVNRHEHHPRVGKTNLEACMIKDLVLMRQNNINAVRNSHYPQHQRWYELCDIFGLYVIDEANIEKHGFDESSHFKHPKVEPSGQVLCLIVLLGLLKEDADGSKNWAYGGDFGDTPNDLNFCLNGIVWPDRTIHPAVHEVKYLYQPIKITMMDSMLKIENVQFFATTEALEFSWLLHGDGCALGSGSLNVPSLAPQSTHLINMESSPWFTIWSTCAVKEIFLSINVKLRYQTQWAKDGHILASAQICLPPKKGFVPHAIALSRSSLVSERVGDHVLISKSNAWQIKVNSISGTIDSWKVNNIELMSKGIHPCFWRAPTDNDKGGSYAKPYASRWREASLDNISFYSSQFSLKELPDQTVEISTIYYGLPGNQPKPDETSLSDESESVLFRVRMRGRIYDSGDVILDYEVSPKNDLPPLPRVGVVFNADKSLSRAKWYGRGPFECYPDRKAAAHVGVYESGVDDLHVPYIVPGECGGRADVRWVALQNADGFGLFASAYGESPPMQVSASYYGAAELDRATHNHKLVKGDDIEVHLDHKHMGLGGDDSWSPCVHEQYLLPPARYAFSVRLCPLLPSSSCHDIYHSQLPC

SEQ ID NO: 27848 - protein, 98 aa, Arthrospira platensis
ATYKVTLINEAEGINETIDCDDDTYILDAAEEAGLDLPYSCRAGACSTCAGTITSGTIDQSDQSFLDDDQIEAGYVLTCVAYPTSDCTIKTHQEEGLY

SEQ ID NO: 27849 - protein, 144 aa, Triticum aestivum
  misc_feature (10)..(10): Xaa can be any naturally occurring amino acid
SHPGNPAIVXFDWTTSGTPRRSARISEKTKATPIPNKEPPKKRGRTKSAVSKKDAEGEKSEGGGEENSHVKDTEMNPPEGIAQNENVTDKNGSGETERVNDAKENIVAEETPNAAPVQEEGESMKEKALDSVDDKSKETDKEKD

SEQ ID NO: 27850 - protein, 183 aa, Arabidopsis thaliana
MYLTCRFEESKSAEKAVVALEESTSGEPKTPTESHEKLRKVRSDQGSSTTSSNQENIGSSSVSFRNQVLQSTVTNQKQDSPIPVESNREKAASKEVEAGSQSTNEGIAGQSSSTEKPKEEESAKQRWSRSQREAALMKFRLKRKDRCFDKKVRYQSRKKLAEQRPRVKGQFVRTVNSDASTKS

SEQ ID NO: 27851 - protein, 181 aa, Arabidopsis thaliana
MASSMFSSTAVVTSPAQATMVAPFTGLKSSASFPVTRKANNDITSITSNGGRVSCMKVWPPIGKKKFETLSYLPDLSDVELAKEVDYLLRNKWIPCVEFELEHGFVYREHGNTPGYYDGRYWTMWKLPLFGCTDSAQVLKEVEECKKEYPGAFIRIIGFDNTRQVQCISFIAYKPPSFTEA

SEQ ID NO: 27852 - protein, 966 aa, Unknown
  Synechococcus sp. CC9311
MAEPLSPFVSRHIGPGEQAQQRMLKALGFKDLDSFLRAVVPANIFDALPPVEALPRGCTEASALAELRGLADANQVRRSLIGLGYYDTVTPAVIQRQVLENPSWYTAYTPYQAEIAQGRLEALFNFQTLISELTGLPIANASLLDEGTAAAEAMAMSLSTCRRQEAKRFLVDAAVLPQTLAVLQTRALPIGVELEVVEPEAFRWGDDVFGVLLQLPGRCGRLWDPSACISAAHDSGALVTVAVDPLAQVLLAPVGELGADIAVGSTQRFGVPMGGGGPHAAFFATRDAFRRQVPGRIVGQSRDADGQPAFRLALQTREQHIRRDKATSNICTAQVLLAVMASFYAIHHGPEGLEAMAQKLVALRLQLEQAVRQLGYSLEAKPRFDSFDVYGSMAPQVHRLAAVEGINLRVLPDGASVETAQGFGISLDELSDLDEITRLIAVLAQAVDAPVPSTLGELSSDPLLNVVPCRRESWLQQSVFHRYRSETELMRYIQRLVSKDLSLVHGMIPLGSCTMKLNAASELVPVSWREFAGMHPFAPLDQQRGSQRMVEDLETWLAALTGFAGVSLQPNAGSQGEYAGLLVIRAWHHSRGETSRNVCLIPTSAHGTNPASAVMAGMRVVPVACDDEGNVDVEDLRAKAEQHSASLAALMVTYPSTHGVFEVRIREICALVHEHGGQVYLDGANLNAQVGLCRPGSFGADVCHLNLHKTFCIPHGGGGPGVGPIGVASHLLPFLPGHPFMDCGGEQATQPVSAAPWGSAGILPISWMYLRLMGPYGLRQATAIALLSANYLASRLDAHYPVLFRGESGLVAHECILDLRGLKRTAGLEVDDLAKRLMDFGFHAPTVSWPVAGTVMVEPTESESLEELDRFCDAMIAIRAEAAAIEDGSSDRENNPLRRAPHTLAAVTADSWDRPYSRQQAAFPLPEQASNKFWPSVARIDNAFGDRNLICTCPSVEEMAEPVAMR

SEQ ID NO: 27853 - protein, 378 aa, Streptomyces avermitilis
MATDYYAVLGVRRDASQDEIKKAFRRLARELHPDVNPDPKTQERFKEINAAYEVLSDPQKKQVYDLGGDPLSQSGGGGAGGFGAGGFGNFSDIMDAFFGTASQRGPRSRTRRGQDAMIRVEIELDEAAFGTTKDIQVETAVVCTTCSGEGAAPGTSAQTCDMCRGRGEVSQVTRSFLGQVMTSRPCPQCQGFGTVVPTPCPECAGDGRVRSRRTLTVKIPAGVDNGTRIQLAGEGEVGPGGGPAGDLYVEIHELPHQTFQRRGDDLHCTVTIPMTAAALGTKVPLETLDGMEEVDIRPGTQSGQSIPLHGRGITHLRGGGRGDLIVHVEVTTPTKMDPEQERLLRELAKLRGEERPTGQFQPGQQGLFSRLKDAFNGR

SEQ ID NO: 27854 - protein, 334 aa, Unknown
  Frankia sp. EAN1pec
MRRAAVLTAGSWGTVFAKVLADAGARVTLFARDRAIADAINGRHVNPRYLADVRLPDLVRATSSPERALRDADLVVLAVPSQALRSCLVEWAPLVGPGAVYVSLMKGMEAGSSRRMSEVIAQAAGVGPERIAVVSGPNLAREIAVEHPAATVVASASAATAHAVQAACWTPYLRPYTNADVLGCELGGAVKNVIALAAGMLEGMGFGTNSLASLITRGLAETARLGTALGADPMTFAGLAGLGDLVATCGSPLSRNRTFGEKLGRGMTLDQVLAEQRQVAEGVRSCRPLLALADGLGVSMPITRQVERVLYEGLPPLEAVKDLMSREPGPEYRL

SEQ ID NO: 27855 - protein, 355 aa, Oryza sativa
MASCGFEGFEKRLELVFELPASGGEVARRGLRLLPAEALREVLDAAQCAVVSAAGNAAADAYVLSESSMFVYPGRVVLKTCGTTPLLRAVPVLLRAAAALRLRLRSCRYSRGEYLFPEAQPFPHAHFADEVAYLDAALPRELLRFRRSAVMPSSPGASHRWHVYSASSSASSSDADGAARLTAEVCMTELDRGMAARFYQRPGDGRTSHAIGDEMTAASGIGGVVDENDPRSLVCAYAFAPCGYSMNALDGARYATVHVTPEDGHCYASFECATDDAAAALAAIRRAVAAFRPATVSVSISHTSSAASSLCTPVAEALEPLGLACHCRAAEVFPGAGTVTYQTFTAPATKHEHDN

SEQ ID NO: 27856 - protein, 209 aa, Haemophilus influenzae
MGKKKRSASSSRWLNEHFSDQFVQKAHKQKLRSRAYFKIDEIQQTDKLFKQGMTVVDLGAAPGGWSQYVVSQIGGKGRVIACDILEMDPIVGVDFLQGDFRDENVLNALLARVGEDKVDVVMSDMAPNFSGMPSVDIPRAMYLVELALDMCKQVLANKGSFVVKVFQGEGFDEYLREIRSLFNVVKVRKPEASRGRSREVYIVATGYKG

SEQ ID NO: 27857 - protein, 271 aa, Legionella pneumophila
MVGFVWEAWRLNPGDIYMNNVSMRELLEAGAHFGHRTRFWNPKMSEYIFGSRNKIHIINLEKTLPMLSDVTNYVSRLAANKAKILFVGTKRAAQDSIREHAKRCGMPYVDHRWLGGMLTNYKTVRQSIFRLKELKEMKEKGLFNDMIKKEALMLTRELEKLERSLGGIENMGGLPDALFVVDVGFEHIAVEEARRLRIPVIGVVDTNNSPDNIDYVIPGNDDSMRAVDIYVRCVADAILDGKNSNTVGRVSSDSEFVEVTSNSNEEEKSGE

SEQ ID NO: 27858 - protein, 179 aa, Arabidopsis thaliana
MQDSSSHESQRNLRSPVPEKTGKSSKTKNEQKGVSKQPNFRGVRMRQWGKWVSEIREPRKKSRIWLGTFSTPEMAARAHDVAALAIKGGSAHLNFPELAYHLPRPASADPKDIQEAAAAAAAVDWKAPESPSSTVTSSPVADDAFSDLPDLLLDVNDHNKNDGFWDSFPYEDPFFLENY

SEQ ID NO: 27859 - protein, 511 aa, Zea mays
  misc_feature (55)..(55): Xaa can be any naturally occurring amino acid
  misc_feature (70)..(70): Xaa can be any naturally occurring amino acid
  misc_feature (77)..(77): Xaa can be any naturally occurring amino acid
  misc_feature (87)..(87): Xaa can be any naturally occurring amino acid
MGAMMASITSELLFFLPFILLALLALYTTTVAKCHGTHPWRRQKKKRPNLPPGRXGWPLVGETFGYLRAXHPATSVXGRFMERHVAXRYGKIYRSCLFGERTVVSADAGLNRYILQNEGRLFECSYPRSIGGILGKWSMLVLVGDAHREMRAISLNFLSSVRLRAVLLPEVERHTLLVLRSWPPSDGTFSAQHEAKKFTFNLMAKNIMSMDPGEEETERLRLEYITFMKGVVSAPLNFPGTAYWKALKSRASILGVIERKMEDRLEKMSREKSSVEEDDLLGWALKQSNLSKEQILDLLLSLLFAGHETSSMALALAIFFLEGCPKAVQELREEHLLIARRQRLRGASKLSWEDCKEMVFTQCVINETLRLGNVVRFLHRKVIRDVHYNGYDIPRGWKILPVLAAVHLDSSLYEDPSRFNPWRWKLQSNNAPSSFMPYGGGPRLCAGSELAKLEMAIFLHHLVLNFRWELAEPDQAFVYPFVDFPKGLPIRVQRVADDQGHRSVLTESTRG

SEQ ID NO: 27860 - protein, 236 aa, Citrus sinensis
MARRYWNIHLEEMMEAGIHFGHGTRKWNPRMAPYISAKHKGIHITNLTRTARFLSEACDLVFDAASRGKQFLIVGTKNKAADLVARAAIRARCHYVNQKWLGGMLTNWSTTETRLHKFRDLRTEQKGGRLDSLPKRDAAILKRQLSRLQTYLGGIKYMTRVPDIVIVVDQQEEYTALRECITLGIPTICLIDTNCDPDLADISIPANDDAIASIRLILNKLVFAICEGRSSYIRNP

SEQ ID NO: 27861 - protein, 626 aa, Pediococcus pentosaceus
MQANLQWLDDPEVFRVNQLPAHSDHHYYRDLDEIRTGSSFIKSLNGPWRFHFASTPSERPLHFYSPDFDSADFDTIQVPGHIELAGYSQIQYINTLYPWEGKIYRRPPYTLNQDQLEVGLFSDAADNSVGSYLKHFDLDDSFKNQRVIIQFQGVEEALYVWLNGHFIGYAEDSFTPSEFDLTPYLQDQDNLLAVQVYKRSTAAFIEDQDMYRFSGIFRDVNLLALPAAHVVDLDIKPEVKDDFERGTLAVTADVSGTDAILELTVTDQNKQVVASQTQSGTGKVLFDSMPFDNLKLWSPTNPTLYQLLIKVYNNQHQLLEVVPYQFGFRRVELREDKVIYVNNQRLILNGVNRHEWNAHSGRVITMQDMQNDIQTMLDNNINAVRTCHYPDQLPWYELCDQAGLYVMAENNLESHGSWQKMGAVEPSYNVPGDNPHWLAAVVDRARSNYEWFKNHPSIIFWSLGNESFAGEDIAAMQTFYKEHDASRLVHYEGVVRTPELRDRISDVESRMYETPANIASYLENNPDKPFLNCEYMHDMGNSLGGMQSYNDLIDKYPMYQGGFIWDFIDQALLVHDPITQQDVLRYGGDFDERHSDYEFSGDGLLFADRTPKPAMQEVKYYYGLHK

SEQ ID NO: 27862 - protein, 235 aa, Glycine max
MAATASLHRLSRLRFIAKPQPFLSPHSTPSHFSLTPKTKKPNRFRFRFRSMAAEPKESPSNNPGLHTTPDEATKGYIMQQTMFRIKDPKVSLDFYSRVLGMSLLKRLDFPEMKFSLYFMGYEDTTEAPSNPIDKVVWTFSQKATIELTHNWGTESDPEFKGYHNGNSEPRGFGHIGITVDDTYKACERFQNLGVEFVKKPDDGKMKGIAFIKDPDGYWIEIFDRKTIGNVTQAPA

SEQ ID NO: 27863 - protein, 300 aa, Burkholderia xenovorans
MAYKTIEDTIGNTPLVQLVRLPDDEIRSRNNVILAKLEGNNPAGSVKDRPALSMIKKAEARGRIKPGDTLIESTSGNTGIALAMAAAIRGYKMVLIMPEDLSVERRQSMAAYGAQIVLTPVTGGMEYARDLAEQMQREGKGIILDQFANPDNPAAHVEGTGPEIWRDTEGRITHFVSSMGTTGTIMGVSTYLKEQNQAIEIIGAQPEEGSRIPGIRKWPEAYLPKIFDRSRVDRVENVSQAAAEAMARRMASVEGIFAGISSGGACEVALRVARQVENATIVFIVCDRGDRYLSTGVFPA

SEQ ID NO: 27864 - protein, 311 aa, Oryza sativa
MDPDAVKSTLSNLAFGNVMAAAARDYQKVTSLTHSRNWLWRLVSEPGVLLDGSRHQRGGIESRFLIGSGVDGRLIRPRSTRLSCAAGLQPWIVEGRGNGEDDLVILLIFFLDLQQQNVVFASKCRGSFATGMDCGRYNHRSTWRMILEIVAKEKAQAANASHDEVDLDELLDDPELEKLHAERIAALKKEVEKREVLKRQGHGEYREITEGDFLGEVTGSEKNAPFFVTKLGIKTLPCVILFKKGIAVDRLVGFQDLGSKDDFSTRALENILKMKGIIDEKKKDEDDEDDETDMSMNRRIRSSTAQDSDSE

SEQ ID NO: 27865 - protein, 296 aa, Unknown
  Rhizobium sp. USDA 1114
RGKTQIKEFDAFPTLEQLPLWGFDGSSTQQAEGRSSDCVLKPVAVYPDPVRTNGALVMCEVMMPDGKTPHPSNTRATVLDDESAWFGFEQEYFFYKNGRPLGFPEQGYPAPQGPYYTGVGYKNVGDIARQIVEEHLDICLAAGINHEGINAEVAKGQWEFQVFGKGSKKAADEVWLARYLLLRLTEKYGIDVEFHCKPLGDTDWNGSGMHANFSTAYLREVGGKDYFEALMAAFEKNLHDHINVYGPDNHLRLTGKHETAPWDKFSYGVADRGASIRVPHSFVNNGYRGYLEDRRP

SEQ ID NO: 27866 - protein, 418 aa, Pseudomonas aeruginosa
MFSKHDQLQGYDDELLAAMDAEDRRQEDHIELIASENYASKRVMQAQGSGLTNKYAEGYPGKRYYGGCEHVDKVERLAIDRARQLFGADYANVQPHSGSSANAAVYLALLNAGDTILGMSLAHGGHLTHGAKVSSSGKLYNAVQYGLDTATGLIDYDEVERLAVEHKPKMIVAGFSAYSKTLDFPRFRAIADKVGALLFVDMAHVAGLVAAGLYPNPIPFADVVTTTTHKTLRGPRGGLILARANEEIEKKLNSAVFPGAQGGPLMHVIAAKAVCFKEALEPGFKDYQAQVIRNAKAMAEVFIGRGYDVVSGGTDNHLMLISLVKQGLTGKAADAALGAAHITVNKNAVPNDPQSPFVTSGIRIGTPAVTTRGFREGECRELAGWICDILDDIDNPEVGERVRGQVGEFCRHFPVYAD

SEQ ID NO: 27867 - protein, 472 aa, Pediococcus pentosaceus
MTLEPVKYKKFIAPLVVGVILWLLSPVKPVGVSLAAWHIFAIFVATIIGCITQPLPIGGVAIVGFSITVLTGEVPMDKAITGFGNDSIWLIVMAFFISRGFIKTGLGRRIAFHFVSMFGKKTLGLAYSLIGVDLVLAPATPSNTARAGGIMFPIIESLASAFGSSPKDHTQGKIGSFLLFSEFHGNIITAAMFLTAMAGNPLTQSLAKPLGIHITWMNWFIAGVVPGIISLIVVPLIIYKIYPPEIKETPNAKEWSKKQLDAMGKVSTAEKFMVLTFIVALVLWILGSFLGIDATLTAFIALSLLLVTGVLSWGDVTKETGAWNTLVWFSVLVMMAGQLNELGFIPWLSKTIGTSLHGMNWMLVLVILILAYFYSHYLFASATAHVSAMYGAFLAVAVSSGVPPLLAALMLGFFGDLIGSTTHYGNGPAPILFGSGFVTQKDWWRMNAILGVVYIVIWVGIGSLWMKVIGMW

SEQ ID NO: 27868 - protein, 959 aa, Pseudomonas aeruginosa
MTDNLNLGTIDLGTDDEFIARHIGPRAADTQAMLQRLGYDSLDTLIGNVIPDSIKGSSVLDLPAGMGEAEALASLKAIAARNRALRSFIGQGYYNCHTPAPILRNLLENPAWYTAYTPYQPEISQGRLEALLNFQTLVSDLSGLPIANASMLDEATAAAEAMTFCKRLSKNRTSQAFFASRHCHPQTLDVLRTRAEPLGIEVVVGDESAIEDFSAYFGALLQYPTCDGEIVDYRELVSRFHAVDALVAVAADLLALTLLTPPGEFGADVAIGSAQRFGVPLGFGGPHAAYFATRDAFKRDMPGRLVGVSIDRHGKPAYRLAMQTREQHIRREKATSNICTAQVLLANIASMFAVYHGPQGLLRIARRTHRLTAILAAGLERLGVAVEQKHFFDTLSLATGARTAAIHAKARAAGINLREIDAGRLGLSLDETVRQADVETLWGLLAEEGQALPDFAALAASSGDRLPVELLRQSAILSHPIFNRHHSETELMRYLRKLADKDLALDRTMIPLGSCTMKLNAASEMIPVTWAEFGNLHPFAPAEQSEGYRQLTDELEAMLCSATGYDAVSLQPNAGSQGEYAGLLAIRAYHQSRGDSQRDICLIPSSAHGTNPATASMVGMRVVVVACDARGNVDVEDLRNKASEHKERLAALMITYPSTHGVFEEAIREICAIVHDCGGQVYIDGANMNAMVGLCAPGKFGGDVSHLNLHKTFCIPHGGGGPGVGPIGVRAHLAPFLPGHARGERKEGAVSAAPYGSASILPITWMYIRMMGGEGLKRASEMAILNANYIAHRLEEHYPVLYAGGNGLVAHECILDLRPLKDSSGISVDDVAKRLMDFGFHAPTMSFPVAGTLMIEPTESESKAELDRFCDAMIRIREEIRAVERGELDKEDNPLKNAPHTAAELLGEWNHAYSREQAAYPLASLVEAKYWPPVGRVDNVYGDRNLTCSCPPIEAYSEE

SEQ ID NO: 27869 - protein, 308 aa, Nostoc punctiforme
MSDEDQFDIFLCHNSKDKPEVIEIAHELTRQGIKPWLDKWELRPGLAWQSLLEEQIENIKSAAVFVGSSGLGPWQSQEMRAFLNEFVERNCPVIPVLLGNTPQQPKLPVFLRGNTWVDFRTDTEAMGQLIWGITGKRPERKLKLQPVIQVDDLSSEKGVNYTRLRDLLAAGKWKEADEETLAVMLKASSREEEGWFDIESINNFPCTDLRTIDQLWVKYSDGRFGFSVQKNIYLSVGGKADGEYYKEVWEKFGDRVGWRVKGYWIDNEDVAFNTSAFEGHLPDCLEFKEGLGEEVFSFLASRLVNCNI

SEQ ID NO: 27870 - protein, 296 aa, Unknown
  Rhizobium sp. USDA 1115
  misc_feature (162)..(162): Xaa can be any naturally occurring amino acid
RGKTQIKEFDAFPTLEQLPLWGFDGSSTQQAEGRSSDCVLKPVAVYPDPVRTNGALVMCEVMMPDGKTPHPSNTRATVLDDESAWFGFEQEYFFYKNGRPLGFPEQGYPAPQGPYYTGVGYKNVGDIARQIVEEHLDICLAAGINHEGINAEVAKGQWEFQXFGKGSKKAADEVWLARYLLLRLTEKIRIDVEFHCKPLGDTDWNGSGMHANFSTAYLREVGGKDYFEALMAAFEKNLHDHINVYGPDNHLRLTGKHETAPWDKFSYGVADRGASIRVPHSFVNNGYRGYLEDRRP

SEQ ID NO: 27871 - protein, 715 aa, Salmonella typhimurium
  misc_feature (140)..(140): Xaa can be any naturally occurring amino acid
MKKVVTVCPYCASGCKINLVVDNGKIVRAEAAQGKTNQGTLCLKGYYGWDFINDTQILTPRLKTPMIRRQRGGKLESVSWDEALNYVAERLSAIKAKYGPDAIQTTGSSRGTGNETNYVMQKFARAVIGTNNVDCCARVXHGPSVAGLHQSVGNGAMSNAINEIDNTDLVFVFGYNPADSHPIVANHVINAKRNGAKIIVCDPRKIETARIADMHIALKNGSNIALLNAMGHVIIEENLYDKAFVASRTEGFEEYSKIVESYTPESVEEITGVSAQEIRQAARMYASAKSAAILWGMGVTQFYQGVETVRSLTSLAMLTGNLGKPSAGVNPVRGQNNVQGACDMGALPDTYPGYQYVKFPENREKFAKAWGVESLPAHTGYRISELPHRAAHGEVRAAYIMGEDPLQTDAELSAVRKAFEDLELVIVQDIFMTKTASAADVILPSTSWGEHEGVFSAADRGFQRFFKAVEPKWDLKTDWQIISEIATRMGYPMHYNNTQEIWDELRHLCPDFYGATYEKMGELGYIQWPCRDTSDADQGTSYLFKEKFDTPNGLAQFFTCDWVAPIDKLTEEYPMVLSTVREVGHYSCRSMTGNCAALAALADEPGYAQINTADAARLGIEDEALVWVHSRKGKIITRAQVSDRPNKGAIYMTYQWWIGACNELVTENLSPITKTPEYKYCAVRVEPIADQRAAEQYVIDEYNKLKTRLRESAMG

SEQ ID NO: 27872 - protein, 395 aa, Oryza sativa
MAVLSVADSPPVSAIGFEGYEKRLEITFSEAPVFADPNGRGLRALSRAQIDSVLDLARCTIVSELSNEVFDSYVLSESSLFVYPYKIVIKTCGTTKLLLAIPRILELAEELSLPLEAVKYSRGTFIFPEAQPSPHKNFSEEVAVLNRYFGGLKSGGNAYVIGDPAKPGQKWHVYYATQHPEQPVVTLEMCMTGLDKKKASVFFKTSADGHTTYAKEMTKLSGISDIIPEMEVCDFDFEPCGYSMNAIHGPAFSTIHVTPEDGFSYASYEVMGFNPASLAYGDLVKRVLRCFGPLEFSVAVTIFGGRNHAGTWAKGLDVGAYSCSNMVEQELPSGGLLIYQSFTATAEIATGSPRSVLHCFADENTEKAGKMEALYWEDDAVEEIDGTEGKKMRSC

SEQ ID NO: 27873 - protein, 293 aa, Unknown
  Rhizobium sp. USDA 1177
RGKTQIKEFDAFPTLEQLPLWGFDGSSTQQAEGRSSDCVLKPVAVYPDPVRTNGALVMCEVMMPDGKTPHPSNTRATVLDDESAWFGFEQEYFFYKNGRPLGFPEQGYPAPQGPYYTGVGYKNVGDIARQIVEEHLDICLAAGINHEGINAEVAKGQWEFQVFGKGSKKAADEVWLARYLLLRLTEKYGIDVEFHCKPLGDTDWNGSGMHANFSTAYLREVGGKDYFEALMAAFEKNLHDHINVYGPDNHLRLTGKHETAPWDKFSYGVADRGASIRVPHSFVTRCSASTSST

SEQ ID NO: 27874 - protein, 138 aa, Cucurbita moschata
MGMGMLEVHLISGKGLQAHDPLNKPIDPYAEINYKGQERMSKVAKNAGPDPLWDEKFKFLAEYPGSGGDFHIFFKVMDHDAIDDDDLIGEVKIDIKDLLAEGVRKGWSKIPPRMYQVLLLNLYFKGEIEVGVSFQRQG

SEQ ID NO: 27875 - protein, 305 aa, Panicum maximum
MAFVMGARIAGFMLLLVLMVEAGVYAGTGSQHVDANEWSMVPGVLGEMIQRGMTSRLEDYKYQPPAHDRSCTLLYEATARCSSTSMLFFNEHDVLEGKTFPMYFPPSVTAKLGFLQRRVVQEIPFTSARLADILALFHIPPGSSEAADVATTLGLCDAAAHGDVVRCVTSPDDMVGRAAAVLGTSNMQVLAPSIPTGGMSLQPYTVRAVKPVDGSDFVGCHPELYPYSVYRCHTSVQTGTYVMEMQSSYGNGGALKLVAVCHRNTTSWDPEHVSFKVLASKPGGLPICHFVPYGHVIFGKRAPDA

SEQ ID NO: 27876 - protein, 178 aa, Bacillus clausii
MAIEKAMFAGGCFWCMVQPFDQLPGIKAIVSGYSGGHTKNPTYEQVKTGETGHYEVVEITYDSEQFPYSKLLELYWPQIDPTDDGGQFQDRGSQYRTAIFYYTEEQKQLAEASKAELNNSNRFNKPIVTAILPASTFYRAEEEHQDFYKKQPKAYKQDRAQSGRDEFIAMNWKENKPR

SEQ ID NO: 27877 - protein, 297 aa, Unknown
  Rhizobium sp. USDA 1944
  misc_feature (282)..(282): Xaa can be any naturally occurring amino acid
RGKTQIKEFDAFPTLEQLPLWGFDGSSTQQAEGRSSDCVLKPVAVYPDPVRTNGALVMCEVMMPDGKTPHPSNTRATVLDDESAWFGFEQEYFFYKNGRPLGFPEQGYPAPQGPYYTGVGYKNVGDIARQIVEEHLDICLAAGINHEGINAEVAKGQWEFQVFGKGSKKAADEVWLARYLLLRLTEKYGIDVEFHCKPLGDTDWNGSGMHANFSTAYLREVGGKDYFEALMAAFEKNLHDHINVYGPDNHLRLTGKHETAPWDKFSYGVADRGASIRVPHSXVNNGYRGYLEDRRPN

SEQ ID NO: 27878 - protein, 138 aa, Cucurbita moschata
MAMGMLEVHLISGKGLRAHDPLNKPIDPYVEINYKGQERMSKVAKNAGPDPVWNEKFKFLAEYPGSGGDFLILFKVMDHDVIDGDDYIGDVSIDVKDLLVEGVRKGWSELPPRMYQVIAHKLYFKGEIEVGVSFKRQG

SEQ ID NO: 27879 - protein, 294 aa, Unknown
  Rhizobium sp. USDA 3394
RGKTQIKEFDTFPTLEQLPLWGFDGSSTMQAEGRSSDCVLKPVALYPDPARTNGALVMCEVMMPDGVTPHASNARATILDDEDAWFGFEQEYFFYQNGRPLGFPEQGYPAPQGPYYTGVGYSNVGDVAREIVEEHLDLCLAAGINHEGINAEVAKGQWEFQIFGKGSKKAADQIWMARYLLQRLTEKYGIDIEYHCKPLGDTDWNGSGMHCNFSTKYMREVGGKDYFEALMAAFDKNMMDHIAVYGPDNDKRLTGKHETAPWNKFSYGVADRGASIRVPHSFIKNDYKGYVEDR

SEQ ID NO: 27880 - protein, 150 aa, Cucurbita maxima
MGMGMMEVHLISGKGLQAHDPLNKPIDPYAEINFKGQERMSKVAKNAGPNPLWDEKFKFLAEYPGSGGDFHILFKVMDHDAIDGDDYIGDVKIDVKNLLAEGVRKGKSEMPPRMYHVLAHKIHFKGEIEVGVSFKLQGGGGCGGCNPWEN

SEQ ID NO: 27881 - protein, 159 aa, Brassica napus
MEPPKDQHTPEKSSTDPPSSAYPPSGCCTNCGGPTISEPSPLASLPEMSPPPNYRPIRAPAINLPHNSQAIILSPVPHAERVPVVSPPYQFERPVKRIHSPDDIRRFQESPSFKNFLGFVVSLSESIRGHKISDPCLVSPTVAAVVSILETLLQWIDEI

SEQ ID NO: 27882 - protein, 221 aa, Kluyveromyces lactis
MAVPKENITTAHPLTAEITTKDEDDKSLDSLLEQLDEEESEFLSQYRDQRLEELSEHMKKIEKNVESGDYGSVQTFLDEQRLIQVTASAERCVVHFFVDSFRKCQVMDSKLQVMAESHLSTRFFRISVADCPFLVEKLSLKVLPVVIAYQNGKEQDRLIGFAKLGNNANDFSIDHLEKWLQRSGVVPMRDTKLTIISNRSKQIRSKNKTNSDQEDSGSDWD

SEQ ID NO: 27883 - protein, 440 aa, Prochlorococcus marinus
MENKQINFFKTKDINTVLKPFKKGTVVNIDNLEVREKQKELKLGLHGWYAICPSTELKKNKIHYFSLFDEPLLLFRDKNNNVRCIKNICPHRGSSFYGGSISNGELTCPYHGARFSSQGNCQNIDRITCSHIVDNNYDNYAKRIHLSQFKVVERESYIFIYFTDKSETDLNKFNDDSLISNYDLTANGFSVKDSVSEEVLVDFKCDWSRIIENHLDILHIFWVHGDTIPDKDVNKNVLVSFNQKININPNYIESIYFYKNNPTKEFIRIKYIPPGRILIYKGDPAASRYVQVLDHIPLGDNKARVIVRHYRKFLKNKFLNNLILFKEIQKKIFYKIFDEDYMILKTQTYNQKLGLIKNDEIKLLGEDRIINYFWNWYKKSEEKDNPWKHINKNKELNVYDEIILKYPPEIKKLEVINNINIIRKTFIRYAAPLVFLLLII

SEQ ID NO: 27884 - protein, 138 aa, Cucurbita maxima
MGMGMMEVHLISGKGLQALDPLNKPIDPYAEINFKGQERMSKVAKNAGPDPIWNEKFKFLVEYPGSGGDFHILFKVMDHDAIDGDDYIGDVIIDVQNLLAEGVRKGWSELPPRMYQVLAHKIYFKGEIEVGVFFQRQG

SEQ ID NO: 27885 - protein, 101 aa, Pogonatherum paniceum
ADAIKSLVTPTPEGDWFSTGVYTTGNPYGIAEDIVFSMPCRSKGDGDYELATDVSMDDFLWERIKKSEAELLAEKKCVAHLTGEGNAFCDLPVDTMLPGEK

SEQ ID NO: 27886 - protein, 621 aa, Hordeum vulgare
MFGRDPWGGTLEISNADSATDDDRSRDLDRGAMMRHQLDETQQSWLLAGPGDQAGKKKKKYVDIGCMVIDRKIFMWTVGLVLGVGLFVGFVMMIVKLVPHKKPPPPPPDQYTLALHKALMFFNAQRSGHLPKHNGVSWRGNSGMKDGLPDSTVKKSLVGGFYDAGDAIKFNFPMAWSMTMLSWTVIEYRAKYEAIGELDHVKEIIKWGTDYMLKTFNSSADTIDRIVAQVGVGDTSKGPMPNDHYCWMRPEDIDYKRPVIECHSCSDLAAEMAAALAAASIVFKDSKAYSDKLVHGAKALYKFGRLQRGRYSPNGSDQSLFYNSTSYWDEFVWGGAWMYFATGNTSYLTIATAPGMAKHAGAFWIGSPNYGVFTWDDKLPGSQVLLSRLRLFLSPGYPYEEILRTFHNQTDNVMCSYLPVFNSFNFTKGGLIQLNHGGPQPLQYVVNAAFLASLYADYLDTADTPGWYCGPNFYTTDVLRKFAKSQLDYILGKNPQKMSYVVGFGKKYPKRVHHRGASIPHNGVKYGCKGGFKWRESKKANPNILVGAMVAGPDKHDGFKDIRTNYNYTEPTLAANAGLVAALISLADIDTGRYSIDKNTIFSAVPPMFPTPPPPPSAWKP

SEQ ID NO: 27887 - protein, 285 aa, Ralstonia metallidurans
MQTTGKVWLVGVGPGDPELATMKAVRALREADVWLVDDLVPEAMLCYANPGTQIISVGKRGGRCSVSQSSIHEQALEHAQAGRCVARVKGGDPLLFGRGGEEAEFLRGHGIEVEIVNGISSGMAAAQALGIALTHRQHCHGVTFVTAHTRDDGDPDWAALVGSRTTLVIYMGMSRLAAIRDALLQAGMRSEMPVAVVMHASRGDEKRWVGSLATLTEAADAGLASPAVILVGEVVDIPNPASLTDQHAFGDLAAGLPSKQPEHDLQRERQRAHQEDHITEGTHPA

SEQ ID NO: 27888 - protein, 532 aa, Unknown
  Synechococcus sp. CC9311
MSFPDFSAIDSQTQWQRFCDLLWYHDDLGLWLDVSRMHLNSSALETLTPRLEQAFKAMEDLEGGAIANADEQRQVGHYWLRQPQLAPDQQVGASISAEIDAIDEFGKSILAGSIQAPNGQPFTDVLWIGIGGSALGPLLMVRALQDHQVGLPFHFFDNVDPNGMSRVLAGLGDRLRTTLVITVSKSGGTPEPHLGMEQARHRLEAHGGSWAKQAVVVTMAGSKLDQQAEKENWLQRFDMFDWIGGRTSITSAVGLLPGALIGCDIRGFLAGAAQMDEATRCPDVRRNPSALMAAAWYAAGEGKGKRDMVVLPYRDRLEVFSRYLQQLVMESLGKHLDRDGKEVHQGIAVYGNKGSTDQHAYVQQLRDGIDNFFVTFIEVLRDVDDIPSIEGERPGDFLDGFLQGTRSALTEGGRQSLSISMRSFDARRLGALIALFERAVGLYGELVNVNAYHQPGVEAGKKAAAAILNLQKQVEEVLSDGVSRSAVEIQKAIGSGTDEAIFWILRHLTGNNRGYVAQGSWDHPASMRFSKG

SEQ ID NO: 27889 - protein, 475 aa, Brucella melitensis
MSLSQTRLLADFPAFFRVSGEVVAVVGGGEEALNKARLVAQTAARLRIIAEKAEPHLAAFIESHGVEHIASPFAPELLDGAKLVFVATGDEAGDRAAAAAARARKIPVNVVDRPALCDFLTPAIVNRAPVTIAIGSQGTAPVLAQMVRARIDAAFSPRLGELAHFAESWRPLVERALPKGLARRGFWRTFFSGKVARAVESGDHEAAHRAAAELIGQGQDASGHVWLVGAGPGAEDLLTLRAQRVLMEADVIVHDALVPEGVIAMGRRDAERLPVGKRKGCHSKSQGEINRLLVKLGQEGKRVVRLKSGDPLVFGRAGEEMAALRAAGIGFEVVPGITSAFAAAADMELPLTLRGVASSLVFTTGHDMTGDVLPGWAKLAVSGATIAVYMGSTVAASVASRLIAAGLHEDTAVAVVENASRSNKRMFHGTLKDLPQLENRKELSGPVMVVIGDAVAGAAIGRAQALSLKPVPVAA

SEQ ID NO: 27890 - protein, 268 aa, Arabidopsis thaliana
MSQLLSSPPMAVFSKTFINHKFSDARFLSSHSILTSGGFAGKIIPLKPTARLKLTVKSRQSDYFEKQRFGDSSSSQNAEVSSPRFYVGHSIYKGKAALTIEPRAPEFVALESGAFKLTKEGFLLLQFAPAAGVRQYDWSRKQVFSLSVTEIGNLVSLGPRESCEFFHDPFKGKGSDEGKVRKVLKVEPLPDGSGRFFNLSVQNKLLNVDESVYIPITKAEFAVLISAFNFVLPHLIGWSAFANSIKPEDSNRLNNASPKYGGDYEWSR

SEQ ID NO: 27891 - protein, 473 aa, Sulfurospirillum deleyianum
GIAGKEKSEEWAKYYPRQFDSWKKTKEYDSFTDMLAKDPALVIAWSGYAFSKDYNSPRGHYYALQDNVNSLRTGAPVDAKTGPLPTACWTCKSPDVPRLIEEDGELEYFTGKWAKYGSQIVNVIGCANCHDDKTAELKVRVPHLNRGLQAAGLKTFEESTHQDKRTLVCAQCHVEYYFKKTEWKDAKGADKTAMVVTLPWANGVGKDGNAGVEGMIKYYDEINFSDWTHNISKTPMLKAQHPGFEFWKSGIHGQKGVSCADCHMPYTQEGSVKYSDHQVKENPLDSMDQSCMNCHRESESKLRGIVHQKYERKEFLNKVAFDNIGKAHLETGKAIEAGASDEELKEVRKLIRHGQFKADMAIAAHGNYFHAPEETLRLLAAGSDDAQKARLLLVKILAKHGVMDYIAPDFDTKDKAQKLAKVDIAALAAEKMKFKQTLEQEWKKEAKAKGRANPELYKDVDTINDGKSSWNKK

SEQ ID NO: 27892 - protein, 99 aa, Agrobacterium tumefaciens
MCRDCVVSAQFSRTGHVRHYQQEENPYMTKEEVLEFPGIVTELLPNATFRVKLENEHEIIAHTAGRMRKNRIRVLAGDKVLVEMTPYDLTKGRITYRFK

SEQ ID NO: 27893 - protein, 295 aa, Unknown
  Nostoc sp. PCC 7119
DVPVNLYRPNAPFIGKVISNEPLVKEGGIGIVQHIKFDLTGGNLKYIEGQSIGIIPPGVDKNGKPEKLRLYSIASTRHGDDVDDKTISLCVRQLEYKHPESGETVYGVCSTYLTHIEPGSEVKITGPVGKEMLLPDDPEANVIMLATGTGIAPMRTYLWRMFKDAERAANPEYQFKGFSWLVFGVPTTPNILYKEELEEIQQKYPDNFRLTYAISREQKNPQGGRMYIQDRVAEHADQLWQLIKNQKTHTYICGLEGMEEGIDAALSAAAAKEGVTWSDYQKDLKKAGRWHVETY

SEQ ID NO: 27894 - protein, 445 aa, Gibberella zeae
MTSTTPPKLNALEILDLRSSPPAFTTPSKRINEGSDVARFLTSLAYRDIGVFILQLNRALCPRNQSSSPLPRTFPLNSKPATTPSVQTLQALLAKIGSFIDEAPPDPGPRRFGNVSFRKWHAIFEERLSELLDEGLLGETLKVGDGKAKEEVSLYLLGGFGSVQRLDYGTGHELSFVAFLGCLWKLGFFKDGEQGGEIEREIVLKIIEPYLNVVRKLILTYTLEPAGSHGVWGLDDHSFMPYIFGSAQLTRPINENEPMPLEGSVKGAPKPSDVTKAVVVEDQRQVNMYFSAIGFINDVKKGPFWEHSPILFDISGIRDGWGKINKGMIKMFNAEVLSKFPVVQHFPFGSLFSWDVDPDATTPTQSVHMVNQPAMAAPTPSGPGTSAPWAQATRMPPSGPGIPYSRMPPPGPNSGSLARPPRNTSGTGSTDAQITVTKAPWARDS

SEQ ID NO: 27895 - protein, 404 aa, Oryza sativa
MAAATTSRRGPGAMDDENLTFETSPGVEVISSFDQMGIREDLLRGIYAYGFEKPSAIQQRAVLPIISGRDVIAQAQSGTGKTSMISLSVCQIVDTAVREVQALILSPTRELAAQTERVMLAIGDYINIQVHACIGGKSIGEDIRKLEHGVHVVSGTPGRVCDMIKRRTLRTRAIKLLILDEADEMLGRGFKDQIYDVYRYLPPELQVCLISATLPHEILEMTSKFMTDPVRILVKRDELTLEGIKQFFVAVEKEEWKFDTLCDLYDTLTITQAVIFCNTKRKVDWLTERMRSNNFTVSAMHGDMPQKERDAIMGEFRSGATRVLITTDVWARGLDVQQVSLVINYDLPNNRELYIHRIGRSGRFGRKGVAINFVKKEDIRILRDIEQYYSTQIDEMPMNVADLI

SEQ ID NO: 27896 - protein, 285 aa, Picea glauca
MEHMNTTAQSSSSLYGVHMVEYGGDVGVGSMMALMTEHQPESESIMTSIPIPSSYSSYSHGHGHGHGHGHGHGQSECLLSAAAMFQTSRPCQGANKFEPANAHIGEGGGAGHFVMEQFIPEQAVISDSSISSVKTEVCSGSGGTGVPGQFELIRRKEEGRCARAYAEPSFVVTPLVTSLPPQQQEARMVTSLAVDMDSSCSCKPIEADAMKAKIIAHVHYPRLVAAYIDCQKVGAPPDVVSELDELSQKCHAQQCVATISIGADPELDQFMEAYCEMFIKYQEEL

SEQ ID NO: 27897 - protein, 443 aa, Oryza sativa
MNALAATSRNFKQAAKLLGLDSKLEKSLLIPFREIKVECTIPKDDGTLASYVGFRVQHDNARGPMKGGIRYHHEVDPDEVNALAQLMTWKTAVANIPYGGAKGGIGCSPGDLSISELERLTRVFTQKIHDLIGIHTDVPAPDMGTNSQTMAWILDEYSKFHGYSPAVVTGKPVDLGGSLGRDAATGRGVLFATEALLAEHGKGIAGQRFVIQGFGNVGSWAAQLISEAGGKVIAISDVTGAVKNSNGLDIAKLMKHSSENRGIKGFDGGDAIDPRSLLTEECDVLIPAALGGVINKDNANEIKAKYIIEAANHPTDPEADEASTSDSIWQTNTPTATKCTICLKCFLSEFLLQILSKKGVLILPDILANSGGVTVSYFEWVQNIQGFMWDEEKVNNELKTYMTRGFRDVKEMCRSHHCDLRMGAFTLGVNRVARATVLRGWEA

SEQ ID NO: 27898 - protein, 577 aa, Burkholderia xenovorans
MQILIFMSDLQTSTPNTESFAALFEESLTKQDMRAGEVISAEVVRVDHNFVVVNAGLKSEAYIPLEEFLNDAGEVEVQAGDFVSVAIDALENGYGDTILSRDKAKRLASWLSLEKALDNNELVTGTITGKVKGGMTVMVNGIRAFLPGSLVDTRPVKDTTPYEGKTLEFRVIKLDRKRNNVVLSRRAVIEATQGEERAKLLETLKEGAIVEGVVKNITDYGAFVDLGGIDGLLHITDIAWRRVRHPSEVLSVGQEVTAKILKFDQEKNRVSLGIKQLGDDPWEGISRRYPSGTRLFGKVTNITDYGAFVEVESGIEGLVHVSEMDWTNKNVAPSKVVQLGDEVEVMVLEIDEDRRRISLGMKQCKPNPWDDFSRNFKKGDKLQGAIKSITDFGVFIGLPGGIDGLVHLSDLSWSETGEEAVRKYKKGDEVEAIVLGIDVEKERISLGIKQLEGDPFSNFVAMNDKGSIVDGVVKTVDAKGAVVQLSAEVEGYLRASEIAQDRVEDARNVLKDGDKVNAMIINIDRKSRGINLSIKAKDSAEQQEAIRGLASSDSSSAATGTTNLGALLKAKLDGQNQ

SEQ ID NO: 27899 - protein, 128 aa, Brassica napus
  misc_feature (2)..(2): Xaa can be any naturally occurring amino acid
  misc_feature (10)..(11): Xaa can be any naturally occurring amino acid
  misc_feature (22)..(22): Xaa can be any naturally occurring amino acid
  misc_feature (26)..(26): Xaa can be any naturally occurring amino acid
  misc_feature (35)..(35): Xaa can be any naturally occurring amino acid
  misc_feature (53)..(53): Xaa can be any naturally occurring amino acid
  misc_feature (65)..(65): Xaa can be any naturally occurring amino acid
  misc_feature (71)..(71): Xaa can be any naturally occurring amino acid
  misc_feature (83)..(84): Xaa can be any naturally occurring amino acid
  misc_feature (86)..(86): Xaa can be any naturally occurring amino acid
  misc_feature (93)..(94): Xaa can be any naturally occurring amino acid
  misc_feature (99)..(99): Xaa can be any naturally occurring amino acid
  misc_feature (101)..(102): Xaa can be any naturally occurring amino acid
  misc_feature (105)..(107): Xaa can be any naturally occurring amino acid
  misc_feature (111)..(111): Xaa can be any naturally occurring amino acid
MXSSMLSSAXXVTSPDQATMVXPFTXLKSSAAFPXTRKANNDITSIASNGGKXSCMKVRTPVGKXKFETLXLTFPDLTEVELXXEXDYPSPHXXIPCVXFXXEHXXXHRDXREAPPYAHVEFPTPSRF

SEQ ID NO: 27900 - protein, 291 aa, Unknown
  Rhizobium sp. CIAM1141
GKTQIKEFDTFPTLEQLPLWGFDGSSTMQAEGRSSDCVLKPVALYPDPARTNGALVMCEVMMPDGVTPHATNARATILDDEDAWFGFEQEYFFYQNGRPLGFPEQGYPAPQGPYYTGVGYSNVGDVAREIVEEHLDLCLEAGINHEGINAEVAKGQWEFQVFGKGSKKAADQIWMARYLLQRLTEKYGIDIEYHCKPLGDTDWNGSGMHCNFSTKYMREVGGKDYFEALMAAFDKNLMDHIAVYGPDNDKRLTGKHETAPWNKFSYGVADRGASIRVPHSFVKNDYKGYVE

SEQ ID NO: 27901 - protein, 296 aa, Unknown
  Rhizobium sp. CIAM1143
  misc_feature (216)..(216): Xaa can be any naturally occurring amino acid
RGKTQIKEFDTFPTLEQLPLWGFDGSSTMQAEGRSSDCVLKPVALYPDPARTNGALVMCEVMMPDGVTPHPTNARATILDDEDAWFGFEQEYFFYQNGRPLGFPEQGYPAPQGPYYTGVGYSNVGDVAREIVEEHLDLCLAAGINHEGINAEVAKGQWEFQVFGKGSKKAADQIWMARYLLQRLTEKYGIDIEYHCKPLGDTDWNGSGMHCNFSTXYMREVGGKDYFEALMAAFDKNLMDHIAVYGPDNDKRLTGKHETAPWNKFSYGVADRGASIRVPHSFVKNDYKGYLEDRRP

SEQ ID NO: 27902 - protein, 99 aa, Triticum aestivum
  misc_feature (5)..(5): Xaa can be any naturally occurring amino acid
  misc_feature (9)..(9): Xaa can be any naturally occurring amino acid
  misc_feature (19)..(19): Xaa can be any naturally occurring amino acid
  misc_feature (39)..(39): Xaa can be any naturally occurring amino acid
  misc_feature (41)..(41): Xaa can be any naturally occurring amino acid
  misc_feature (44)..(45): Xaa can be any naturally occurring amino acid
  misc_feature (47)..(47): Xaa can be any naturally occurring amino acid
  misc_feature (67)..(67): Xaa can be any naturally occurring amino acid
  misc_feature (70)..(70): Xaa can be any naturally occurring amino acid
  misc_feature (72)..(72): Xaa can be any naturally occurring amino acid
  misc_feature (76)..(76): Xaa can be any naturally occurring amino acid
  misc_feature (85)..(86): Xaa can be any naturally occurring amino acid
  misc_feature (90)..(90): Xaa can be any naturally occurring amino acid
  misc_feature (97)..(97): Xaa can be any naturally occurring amino acid
EEQMXNMSXEEIAFQVGMXKVDFRKMLKSSLTGLDKTIXAXYRXXQXNMTAEELLPSLWEKCKKEFXDKXTXFLKXIAKIYPTEXXTSVXEMRDILXNL

SEQ ID NO: 27903 - protein, 295 aa, Unknown
  Rhizobium sp. CIAM1146
RGKTQIKEFDTFPTLEQLPLWGFDGSSTMQAEGRSSDCVLKPVALYPDPARTNGALVMCEVMMPDGVTPHASNARATILDDEDAWFGFEQEYFFYQNGRPLGFPEQGYPAPQGPYYTGVGYSNVGDVAREIVEEHLDLCLAAGINHEGINAEVAKGQWEFQIFGKGSKKAADQIWMARYLLQRLTEKYGIDIEYHCKPLGDTDWNGSGMHCNFSTKYMREVGGKDYFEALMAAFDKNMMDHIAVYGPDNDKRLTGKHETAPWNKFSYGVADRGASIRVPHSFIKNDYKGYLEDRR

SEQ ID NO: 27904 - protein, 219 aa, Clostridium perfringens
MDTKELLLSESNEMISGIYERLQSLESLELKSLDKNRTMLLIVDINKGFAKAGALYSDRIEKLINPISNLAKYALNNGIRVKAFTDYHTEDSIELKAYPKHCMKDTDEWELVEELNLEGIEVIKKNSTNGFLEENFILNKEEIDNVIIVGDCTDICIYQLAISLRAEFNRVNKDGEIYVPKKLVDTFDMPMHKANFMNYVFLNSMLDNGVKVIEDIILD

SEQ ID NO: 27905 - protein, 373 aa, Starkeya novella
ADTVTLPFANGERPLVMYPGKRPLIGLTARPPQLETPFSVFDEGLITPNDAFFVRYHLAGIPLEIDPDAFRLEIKGKVGTPLSLSLQDLKNDFPASEVVAVNQCSGNSRGFVEPRVGGGQLANGAMGNARWRGVPLKAVLEKAGVQAGAKQVTFGGLDGPVIPETPDFVKALSIDHATDGEVMLAYSMNGADLPWLNGYPLRLVVPGYYGTYWVKHLNEITVIDKEFDGFWMKTAFRIPDNACACTEPGKAPTATIPINRFDVRSFITNVENGASVKAGEVPLRGIAFDGGYGITQVSVSADAGKSWTNATLDPGLGKYSFRGWKAVLPLTKGDHVLMCRATNARGETQPMQATWNPAGYMRNVVEATRVIAA

SEQ ID NO: 27906 - protein, 584 aa, Unknown
  Candidatus Kuenenia stuttgartiensis
MGLETLKRDYLKEYNVNVADIENDVESVMATEDAMENVQSAYYDSVLHFEVNSILKGRIISSIGDNVIIDCGYKSEGMVPKYEFDDPSEIRIGEEIEVLLEAVEDDSGLIKLSKRKADRIRGWETVIAKYKEGDIITGRIIRKIKGGLLVDIGVPIFLPASQIDVKPPGDIAQYVGQELTCRILKIDEERQNIVVSRRKLIEEEREKKKKLLLMEIEAGQTRKGVVKNIADFGAFIDLGGMDGLLHITDMSWGRISHPSEMLAIDDEVEVKILDVDKEKEKVALGLKQKTDNPWFNIEEKYPVGSRVKGQVVNIMSYGAFVKLETGIEGLVHISEMSWTRRINHPSEIVAIGDMVEVVVLKIDREKEEISLSIKQTEVNPWTIIEEKYPAGTKIKGRVRNLTNYGAFIEIEEGVDGLLHISDMSWAKKVAHPSEIVKKGDKIEAVVLSVDREKKRVALGLKQLQDDPWEKEIPEKYKVGDIVKGHVTKLANFGAFLELGQGIEGLLHVSEFSDKKISNPADAVNVGDELEVKVIRIEPEARKIGLSLKKIAAHPEEKNNSSDNSSSEKVVQEEKAEPSSVVESI

SEQ ID NO: 27907 - protein, 293 aa, Unknown
  Rhizobium sp. CIAM490
GKTQIKEFDTFPTLEQLPLWGFDGSSTMQAEGRSSDCVLKPVALYPDPARTNGALVMCEVMMPDGVTPHASNARATILDDEDAWFGFEQEYFFYQNGRPLGFPEQGYPAPQGPYYTGVGYSNVGDVAREIVEEHLDLCLAAGINHEGINAEVAKGQWEFQIFGKGSKKAADQIWMARYLLQRLTEKYGIDIEYHCKPLGDTDWNGWGMHCNFSTKYMREVGGKDYFEALMAAFDKNMMDHIAVYGPDNDKRLTGKHETAPWNKFSYGVADRGASIRVPHSFIQNDYKGYVEDR

SEQ ID NO: 27908 - protein, 764 aa, Arabidopsis thaliana
MLTSPSSSSTYDPFSSNFSPSLTNAFSSSFTIPMGLKLSRRVTRARIFSRKIKDRSTLKVTCRRAHERVVEEEASTMTETKLFKVSSGEVSPLGVSQVDKGINFALFSQNATSVTLCLSLSQSGKDDTDDDGMIELVLDPSVNKTGDTWHICVEDLPLNNVLYGYRVDGPGEWQQGHRFDRSILLLDPYAKLVKGHSSFGDSSQKFAQFYGTYDFESSPFDWGDDYKFPNIPEKDLVIYEMNVRAFTADESSGMDPAIGGSYLGFIEKIPHLQDLGINAVELLPVFEFDELELQRRSNPRDHMVNTWGYSTVNFFAPMSRYASGEGDPIKASKEFKEMVKALHSAGIEVILDVVYNHTNEADDKYPYTTSFRGIDNKVYYMLDPNNQLLNFSGCGNTLNCNHPVVMELILDSLRHWVTEYHVDGFRFDLASVLCRATDGSPLSAPPLIRAIAKDSVLSRCKIIAEPWDCGGLYLVGKFPNWDRWAEWNGMYRDDVRRFIKGDSGMKGSFATRVSGSSDLYQVNQRKPYHGVNFVIAHDGFTLRDLVSYNFKHNEANGEGGNDGCNDNHSWNCGFEGETGDAHIKSLRTRQMKNFHLALMISQGTPMMLMGDEYGHTRYGNNNSYGHDTSLNNFQWKELDAKKQNHFRFFSEVIKFRHSHHVLKHENFLTQGEITWHEDNWDNSESKFLAFTLHDGIGGRDIYVAFNAHDYFVKALIPQPPPGKQWFRVADTNLESPDDFVREGVAGVADTYNVAPFSSILLQSK

SEQ ID NO: 27909 - protein, 295 aa, Unknown
  Rhizobium sp. CIAM540
RGKTQIKEFDTFPTLEQLPLWGFDGSSTMQAEGRSSDCVLKPVALYPDPARTNGALVMCEVMMPDGVTPHATNARATILDDEDAWFGFEQEYFFYQNGRPLGFPEQGYPAPQGPYYTGVGYSNVGDVAREIVEEHLDLCLEAGINHEGINAEVAKGQWEFQVFGKGSKKAADQIWMARYLLQRLTEKYGIDIEYHCKPLGDTDWNGSGMHCNFSTKYMREVGGKDYFEALMAAFDKNLMDHIAVYGPDNDKRLTGKHETAPWNKFSYGVADRGASIRVPHSFVKNDYKGYLEDRR

SEQ ID NO: 27910 - protein, 340 aa, Glycine max
MIFSRGNTAMSAILLLLGILSSTGVEFTGAQSVGVCYGGNGNNLPTKQAVVDLYKSNRIGKIRLYYPDEGVLQALRGSNIEVILGVPNDQLQSLTNAGAATNWVNKYVKAYSQNVKFKYIAVGNEIHPGDSLAGSVLPALENIQKAISAANLQGQMKVSTAIDTTLLGNSYPPKDGVFSSSASSYIRPIVNFLARNGAPLLANVYPYFAYVNNQQSIGLDYALFTKHGNNEVGYQNLFDALLDSLYAALEKVGAPNVKVVVSESGWPSEGGVGATVQNAGTYYRNLINHAKGGTPKRPSGPIETYLFAMFDENQKDGPEIERHFGLFRPDKSPKYQLSFN

SEQ ID NO: 27911 - protein, 953 aa, Oryza sativa
MLSLQQQGGGDPRPQQPAAAPALLGGADWLGFGRAAAELDESVASSPASFLLPPAPPVDARAQAQPEPKPKQLGAVDVERHLALAHQNYRSGKYKEALEHGNIVYEKNPRRTDNLLLLGAIYYQIRNYDMCIAKNEEALAIDPNFAECYGNMANAWKEKGDVDLAIRYYLTAIQLRPNFCDAWSNLASAYTWKGRLNEAAQCCRQALAINPRLVDAHSNLGNLMKAQGFIQEAYNCYIEALRIDPQFAIAWSNLAGLFMEAGDLDKALLYYKEAVKLKPSFADAYLNQGNVYKTMGMSQEAIISYQRAVQARPDYAMAYGNLATIYYEQGQLDIAIRCYNQAIICDPQFVEAYNNMGNALKDAGRVEEAINCYRSCLALQANHPQALTNLGNIYMEWNLISAAASFYKAAISVTSGLSSPLNNLAVIYKQQGNYADAITCYTEVLRVDPTAADALVNRGNTFKEIGRVNEAIQDYIQAATIRPTMAEAHANLASAYKDSGHVETAIVSYKQALRLRPDFPEATCNLLHTLQCVCDWENRNAMFRDVEEIIRKQIKMSVLPSVQPFHAIAYPIDPMLALEISCKYAAHCSLIASRFGLPSFVHPPPVPVKAEGKHCRLRVGYVSSDFGNHPLSHLMGSVFGMHDRDNVEVFCYALSQNDGTEWRQRIQSEAEHFVDVSAMTSDMIARIINQDKIQILINLNGYTKGARNEIFALQPAPIQVSYMGFPGTTGAAYIDYLVTDEFVSPTCYSHIYSEKLVHLPHCYFVNDYKQKNRDCLDPVCPHKRSDYGLPEDKFIFACFNQLYKMDPEIFDTWCNILKRVPNSALWLLRFPAAGETRVRAHAAARGVRPDQIIFTDVAMKNEHIRRSSLADLFLDTMKEYEDRAVDLALNPAKLQALTNKLKEVRMTCPLFDTARWVRNLERAYYKMWNLYCSGRHREPFKVIEDDNEFPYDR

SEQ ID NO: 27912 - protein, 400 aa, Streptococcus agalactiae
MNEFEDLLNSVSEVNPGDVVTAEVLTVDNGQANVVIDGTGVEGVLTLRELTNDRDADINDFVKAGDTVEVLVLRQVVGKDTDTVTFLVSKKRLEARKAWDKLVGREGEVVTVKGTRAVKGGLSVEFEGLRGFIPASMIDTRFVRNTEKFVGQEFDAKIKEVDAAENRFILSRREVVEESAAAARKEVFSNIEVGSVVTGKVARLTSFGAFIDLGGVDGLVHVTELSHERNVSPKSVVTVGEEVEVKVLSIDEEAGRVSLSLKATTPGPWDGVEQKLAAGDVIEGKVKRLTDFGAFVEVLPGIDGLVHISQISHKRVENPKDVLSAGQEVTVKVLEVNSDAERVSLSMKALEERPAQAEGEKEEKRQSRPRRPRRQEKRDYELPETQTGFSMADLFGDIEL

SEQ ID NO: 27913 - protein, 469 aa, Bacillus subtilis
MNQSQSGLKKELKTRHMTMISIAGVIGAGLFVGSGSVIHSTGPGAVVSYALAGLLVIFIMRMLGEMSAVNPTSGSFSQYAHDAIGPWAGFTIGWLYWFFWVIVIAIEAIAGAGIIQYWFHDIPLWLTSLILTIVLTLTNVYSVKSFGEFEYWFSLIKVVTIIAFLIVGFAFIFGFAPGSEPVGFSNLTGKGGFFPEGISSVLLGIVVVIFSFMGTEIVAIAAGETSNPIESVTKATRSVVWRIIVFYVGSIAIVVALLPWNSANILESPFVAVLEHIGVPAAAQIMNFIVLTAVLSCLNSGLYTTSRMLYSLAERNEAPRRFMKLSKKGVPVQAIVAGTFFSYIAVVMNYFSPDTVFLFLVNSSGAIALLVYLVIAVSQLKMRKKLEKTNPEALKIKMWLFPFLTYLTIIAICGILVSMAFIDSMRDELLLTGVITGIVLISYLVFRKRKVSEKAAANPVTQQQPDILP

SEQ ID NO: 27914 - protein, 668 aa, Fibrobacter succinogenes
MFVKNHALKSVALAALVATALCPAFAATAYINQIGYRPGDFKELALVDANGSVDFVNAAGQVVLSVTPKAASYWDASGQNVQLVDFSKLAEAGKYSIKVNGNVLRSDLVVKSQTYEDIVKASIKWFYYQRASMALESQYAGKWARAAGHTNPTAELHNSTGASGTINSSKGWYDAGDYGRYIVNSGITTYTLLSLYEHFPQYFKTLKWNIPAEGSLPDLLAEIKYNLDWMLTMQASDGGVYHKLTSLGFPGDVMPAADNSKLYAIGKSTAGTFDFAAVMAMASRIYKHASTPYASKCLEAAKKAYAWGQQNPSRNYLANPSDVSTGAYENDNPNDEKVLAGTELFITTGDASYKQSGSSEYVSYWGDVMGLATYEKATHQAQFGGDANEAKQKILGTADNFANRAEKGFGVVMPKDDFVWGSNPVASNQGVCLLYAYYLTGEQKYYKAAVKVLDYLLGKNPLDMSFVTGYGSKSPKMPHHRPSTSDNIEEPIPGMLVGGPQPGGEDVGSAAEWKCADYRTGQAATAYTDQRCSYATNEVAINWNAPLAYLAGAIEAINSGYAPEFAAAGVAKQDVPASSSSEAPASSSSSVPQSSSSEVASSSSAISGNSSSSETVASSSSSQGTIAIHAPVESRMMRSTQPRLRFDDQKVFIEKNGKRFDLKGHRIK

SEQ ID NO: 27915 - protein, 424 aa, Bacillus licheniformis
MVADQNTGHTEENTHDVLKSTQTVIHKALEKLGYPEEVYELLKEPIRFLTVKIPVRMDDGSVKIFTGYRAQHNDAVGPTKGGIRFHPGVTEKEVKALSIWMSLKCGIIDLPYGGGKGGIICDPRDMSFPELERLSRGYVRAISQIVGPTKDVPAPDVFTNSQIMAWMMDEYSRIDEFNSPGFITGKPLVLGGSHGRESATAKGVTICIKEAAKKKNIDIEGASVVVQGFGNAGSYLAKFMYDAGAKVVGISDAYGGLYDPEGLDIDYLLDRRDSFGTVTKLFNDTITNKELLELECDILVPAAIENQITAENAHNIKAKIVVEAANGPTTLEATKILSDRDILLVPDVLASAGGVTVSYFEWVQNNQGFYWTEEEVEERLEKMMVKSFNNIYEMAHNRRIDMRLAAYMVGVRKMAEASRFRGWI

SEQ ID NO: 27916 - protein, 512 aa, Arabidopsis thaliana
MANKYVSSVLKSLLVLLHLVFLSKQHVDSASIVKSLPGFEGQLPFELETGYIGVGEEEEVQLFYYFIKSERNPKEDPLILWLTGGPGCSAISGLLFENGPLTMKLDVYNGTLPSLVSTTYSWTKTSSIIFLDQPVGTGFSYSRTQQFNKPSDSGEAKRIHEFLQKWLGKHQVFSSNPFYVAGDSYSGLVVPATVQEISKGNYECCNPPINLQGYVLGNPLTDYTTGSNSRIPFAHGMALISDELYESLKKTCKGEYTNVHPRNTQCLKFVEEFNKCTNRIFQQLILDPLCETETPDCYIYRYLLTTYWANDATVREALQINKESIGEWVRCYYSIPYNNDIKSSMPYHVNNSISGYRSLIYSGDHDFEVPYLGTQAWIRSLNYSIIDDWRPWMVKNQIAGYTRTYANKMTFATIKGGGHTAESKPEEASIMFQRSFVEAPLGQWLTKGSLMLLQQDVWGSSPNYCDLLVDLQINGGKCAGDLQRCTIMDLIRKKKTKRSFSSILDWIKVARF

SEQ ID NO: 27917 - protein, 593 aa, Arabidopsis thaliana
  misc_feature (53)..(53): Xaa can be any naturally occurring amino acid
  misc_feature (74)..(74): Xaa can be any naturally occurring amino acid
SDQNPTNSQRIRLHRSVRSVQRRYILLRHSLLSGLVGENKRLVGLGGKLNWMXSSSDYSLEKKMKFFESFCSSXGLEAAYQLMEEISPAVALTLGLANTMCDSGISSTFDISELENVTDAADMLCNQKRQRYSNGVVDCIMGSVSEEKTLSEVRSLSSDFSVTVQESEEDEPLVSDATIISEGLIVVDARSEISLPDTVETDNGRVLATAIILNETTIEQVPTAEVLIASLNHDVNMEVATSEVVIRLPEENPNVARGSRSVYELECIPLWGTISICGGRSEMEDAVRALPHFLKIPIKMLMGDHEGMSPSLPYLTSHFFGVYDGHGGAQVADYCHDRIHSALAEEIERIKEELCRRNTGEGRQVQWEKVFVDCYLKVDDEVKGKINRPVVGSSDRMVLEAVSPETVGSTAVVALVCSSHIIVSNCGDSRAVLLRGKDSMPLSVDHKPDREDEYARIEKAGGKVIQWQGARVSGVLAMSRSIGDQYLEPFVIPDPEVTFMPRAREDECLILASDGLWDVMSNQEACDFARRRILAWHKKNGALPLAERGVGEDQACRAAAEYLSKLAIQMGSKDNISIIVIDLKAQRKFKTRS

SEQ ID NO: 27918 - protein, 764 aa, Salinibacter ruber
MQLWPVGLIVSEVCGLIFVVHVERCRLLCAFELSLCCMDASSPSSIDTSPQNRGDRHIQPGKPYPRGATWDGIGVNFALHSAHADRVELLLFEDADDREPAVTFELPEHTGPIWHGYVTNVRPGQLYGYRVYGPYDPANGHRFNPNKVLLDPYAKAIGRPLRWDDSLFGYDVDAEEDDRSFNTQDSAPHAPLAAVVEETFAWGNDQSPEIPWQDTLIYETHVKGMTQKHPDVPERLRGTYLGMASEPVLDHLKTLGVTTVQLLPVHAKLHRRELLRKGLREYWGYNTLSYFAPEPEYAANGPTSAVRDFKMMVRALHDAGLEVIIDVVYNHTCEGNQMGPTLSWRGVDNRTYYKLNPDDERYYMDYTGTGNTLDPGDSYVLQMIMDSLRYWVTEMHVDGFRFDLASALARELYDVDMLGSFFKVVQQDPVLSQVKLIAEPWDVGPGGYQVGSFPWQWAEWNGRYRDTIRRFWRGDRGMNGDVATRVTGSSDLYERSGRRPFASINFVTAHDGFTLQDLVSYERKHNEENKEGNEDGHDDNHSTNCGVEGPTNDPEVIERRERRKRSIMATLLLSQGVPMILGGDELSHTRRGNNNPYCQDNEISWYDWDLDEREQKFLEFVQRLTAFRQEHPSFRRRHFLDPVDESDGSGDVLWWHPDGREITDGDWHDEGLHAFGYLLRGQNLAPDSQGRPRTDDSFLVLMNQGGAPVEVEVPAETNELDDVHCAAWHVVPELAEFLDDPGPVEPGGVLTLRPHRLLVLRAEP

SEQ ID NO: 27919 - protein, 348 aa, Nicotiana tabacum
MALVPTPVVNEGPMFAEVDMGDNSSTPTVRATVVQASTIFYDTPATLDKAERLLAEAASYGAQLVVFPEAFIGGYPRGSTFGVSIGNRTAKGKEEFRKYHASAIDVPGPEVDRLAAMAGKYKVYLVMGVIERDGYTLYCTVLFFDSQGHYLGKHRKIMPTALERIIWGFGDGSTIPVYDTPLGKIGAAICWENRMPLLRTAMYAKGIEIYCAPTADSRDVWQASMTHIALEGGCFVLSANQFCRRKDYPPPPEYVFSGTEDLTPDSIVCAGGSVIISPSGAVLAGPNYEGEALISADLDLGEIARAKFDFDVVGHYARPEVLSLIVRDHAVSPVSFTSTSSKAESSPK

SEQ ID NO: 27920 - protein, 112 aa, Streptomyces avermitilis
MKLITAIVKPYRLDEVKTALQELGVHGLTVTEASGYGRQRGHTEVYRGAEYRVDLVPKVRIEVVVEDADSDAVIDAIVKAAQTGKIGDGKVWSVPVETVVRVRTGERGPDAL

SEQ ID NO: 27921 - protein, 177 aa, Bacillus subtilis
MSEKKEIATFAGGCFWCMVKPFDEQPGIEKVVSGYTGGHTENPTYEEVCSETTGHREAVQITFHPDVFPYEKLLELFWQQIDPTDAGGQFADRGSSYRAAIFYHNDKQKELAEASKQRLAESGIFKDPIVTDILKAEPFYEAEGYHQHFYKKNPAHYQRYRTGSGRAGFISEHWGAK

SEQ ID NO: 27922 - protein, 490 aa, Burkholderia mallei
MTTTNTTTEPAAPGAARAAPATPPIRDCLDRYCIIGGGAAGIATAKNLREHGIAFDLIEREDDIGGTWYYGKPCSAIYQSVHMISSREFSEYTDYPMPADYPTYARGDQALAYLRDYARRFGVYEHAQFNRTVLEVAPLAHGGAWRVELDGHDVRHYKGVFVCNGHLSKPQVPDYPGRFDGLQLHSALYKTPDVLKGKRVLVVGAGNSGCDIAVEAVHHASAVFHSTRRGYFYWPKFLFGIPADRWAEWPLKLRMPLWARRFFGERLLRLTTAGQPEDYGLPKPDHKLFEAHFIINSTLFYHLGHGDLVAKPDVVELKGDRVAFSDGSEERIDAIVYATGFQLSFPFLDQSYLQWDKMQPRLYLNMFDRAHPNLFFIGLFQTSTGNWPLMDYQAQLVARYLRARDAAPRKAARLDRMIGRDRSNWNGGIRFSDTQRHVIEVEHFAYRLQLKRLIRALPDSRVAARQARPVAVASAAPAPAAAARARTGDA

SEQ ID NO: 27923 - protein, 364 aa, Arabidopsis thaliana
MLRSTCCTPLCPFTAKQPSFLRKQQRITSDRFTFRGGGGGDAAAVVSSSGLRDLVFVVNPQGANGRTAKEWKKLLPHLRSRLGKDCNVSELLTSGPSHAIDITREAIRDGADAVIAVGGDGTLHEVVNGFFWEGKPVGYLSGEASRSTALGLIPLGTGSDFARTFGWNNDPCEAVERIARGMRSRIDVGVIDKEGKDLHYFINVADVHLSAKAGFYASKYKKFGNLCYVIGALQAFMGHHNQDMRIRVNGGEWEIYPQVTALCVGNAKYFGGGMKITPNAIPGNGNLEVVVLQNFKWYDFVLKLHKLYNGTHLSVNNVTSRSVQSIEVEEITDSGSIYVQSDGEHLGFLPRKFQVLPGAIDIIS

SEQ ID NO: 27924 - protein, 383 aa, Francisella tularensis
MGASQKNQELIGGLILFSAALLAIVVNNSPLASYYAMLETINVKLGIENLVIDKNLMHWINDGLMAIYFLYIGLEIKREIIVGTLSKLSNIITPAIAAFAGLAMPSLIYLSINHDIKVINGWAIPSATDIAFTLGILALLGTRVPAKLKLLVITIAIFDDIAAIAIIAIFYTKSLSLLSLSLGTLFILAMIICNRIFKINRSSVYVVLGFFAWFCTIKSGVHATLAGFTTALCIPFRENDKDSPANFMEDSLHPWIIYFILPVFAFANAGISFSGISFSILFEPITLGIIWGLFVGKQLGIFSILAVFKKLKWFKLGESFSNLQLYGISLLCGIGFTMSLFIGVLAFNDTHLLNAIKIGVVVGSVLSGFFGYIVLRFIVTNPS

SEQ ID NO: 27925 - protein, 293 aa, Unknown
  Rhizobium sp. USDA 3353
  misc_feature (291)..(291): Xaa can be any naturally occurring amino acid
RGKSQIKDYAEFPTLEQLPLWGFDGSSTQQAEGHSSDCVLKPVAVFPDPARTNGVLVMCEVMMPDGVTPHSSNKRATILDDEGAWFGFEQEYFFYKDGRPLGFPESGYPAPQGPYYTGVGYSNVGSVARQIVEEHLDQCLAAGINHEGINAEVAKGQWEFQIFGKGSKKAADQMWMARYLMQRLTEKYGIDIEYHCKPLGDTDWNGSGMHANFSTAYMREVGGKAYFEALMAAFDKNLMDHIAVYGPDNDKRLTGKHETAPWNKFSYGIADRGASIRVPHSFINNGYKGYXED

SEQ ID NO: 27926 - protein, 294 aa, Unknown
  Rhizobium sp. USDA 3357
  misc_feature (82)..(82): Xaa can be any naturally occurring amino acid
RGKTQIKDYAEFPTLEQLPLWGFDGSSTQQAEGHSSDCVLKPVAVFPDPARTNGVLVMCEVMMPDGVTPHSSNKRATILDDXGAWFGFEHEYFFYKDGRPLGFPESGYPAPQGPYYTGVGYSNVGSVARQIVEEHLDQCLAAGINHEGINAEVAKGQWEFQIFGKGSKKAADQMWMARYLMQRLTEKYGIDIEYHCKPLGDTDWNGSGMHANFSTAYMREVGGKAYFEALMAAFDKNLMDHIAVYGPDNDKRLTGKHETAPWNKFSYGIADRGASIRVPHSFINNGYKGYMEDR

SEQ ID NO: 27927 - protein, 84 aa, Glycine max
  misc_feature (48)..(48): Xaa can be any naturally occurring amino acid
VSGDSSGETALRMAMQTREQHIRRYMATSSICSAQALRANMAAMYAVXHGPEGLKNTAHRVHGLAGAFALGIQKLGTVDIQDLP

SEQ ID NO: 27928 - protein, 236 aa, Acorus calamus
MTKRYWNINLEEMMEAGVHFGHGTRKWNPRMAPYISAKRKGIHITNLTRTARFLSEACDLLFDAASGGKHFLIVGTKKKAADSVASAAIRARCHYVNKKWLGGMSTNWSTTETRLQNFRDLRAEQKAGKIDRLPKRDAAMLKRQLSTLQTYLGGIKYMTGLPDIVIIVDQQEDYTALRECVILGIPTICLIDTNSDPDLADISIPANDDAIASIRLILNKLVFAICEGRSSYIRNR

SEQ ID NO: 27929 - protein, 982 aa, Burkholderia xenovorans
MSDMLNSSTGGCGSGNCACKAQAQQQRSPRSFFDDTDYGTPERHADIDVTLEIDGQSVTVPAGTSVMRAAVEAGVNVPKLCATDSLEPFGSCRLCLVEIEGKRGYPASCTTPVEAGMKVRTQTDRLQSLRRNVMELYISDHPLDCLTCPANGDCELQDMAGVTGLREVRYGFDGANHLKDKKDESNPYFTYDASKCIVCNRCVRACEETQGTFALTIAGRGFESRVAASENVPFMESECVSCGACVAACPTATLQEKTVIMLGQAEHSVVTTCAYCGVGCSFKAEMKGNQVVRMVPHKNGQANEGHACVKGRFAWGYATHKDRITRPMIRAKITDPWREVSWEEALTYAASEFRRIQAKHGRDSIGGITSSRCTNEETYLVQKLVRAAFGNNNVDTCARVCHSPTGYGLKTTLGESAGTQTFASVDKADVIMVIGANPTDGHPVFGSRLKRRVREGAKLIVVDPRRIDIVDTPHVKASHHLQLRPGTNVAVVNALAHVIVTEGLVNEAFVAERCETRAFEQWRDFVALPENAPEATEAATGVPAQAVREAARIYATGGNAAIYYGLGVTEHAQGSTMVMGIANLAMATGNIGREGVGVNPLRGQNNVQGSCDMGSFPHELPGYRHISDTVTRTLFEEAWNVTLQPEPGLRIPNMFDAAVHGTFKGLYCQGEDIVQSDPNTHHVSAALSAMECIVVQDIFLNETAKYAHVLLPGSSFLEKDGTFTNAERRISRVRKVMPPVPGYADWEVTVLLARALGYEMDYTHPSQIMDEIARLTPTFHGVSYKKLDELGSIQWPCNENAPDGTPTMHIDTFVRGKGKFVITKFIATPEKVTRKFPLLLTTGRILSQYNVGAQTRRTENSRWHDEDRLEIHPHDAEERGIRTDDWVGIESRAGQTVLRAKVTERMQPGVVYTTFHFPESGANVITTDSSDWATNCPEYKVTAVQVMPVEQPSQWQRDYSRFNTEQLDLLKQRELANATSGK

SEQ ID NO: 27930 - protein, 296 aa, Unknown
  Rhizobium sp. USDA 3584
RGKTQIKEFAEFPTLEQLPLWGFDGSSTQQAEGHSSDCVLKPVAVFPDPARTNGVLVMCEVMMPDGVTPHASNKRATILDDEGAWFGFEQEYFFYKDGRPLGFPESGYPAPQGPYYTGVGYSNVGSVARQIVEEHLDLCLAAGINHEGINAEVAKGQWEFQIFGKGSKKAADQMWMARYLLQRLTEKYGIDIEYHCKPLGDTDWNGSGMHANFSTAYMREVGGKAYFEALMAAFDKNLMDHIAVYGPDNDKRLTGKHETAPWNRFSYGIADRGASIRVPHSFIKSDYKGYLEDRRP

SEQ ID NO: 27931 - protein, 124 aa, Aspergillus oryzae
MGAIGGAVWHGIKGFRNSPYGERRIGALTAIKARAPVLGGNFGVWGGMFSTFDCAIKGIRKKEDPYNAIIAGFFTGGALAVRGGVKAARNSAIMCAVFLAVIEGVGIGFQRMMADNTKLEVSLI

SEQ ID NO: 27932 - protein, 258 aa, Arabidopsis thaliana
MAMAVSGAVLSGIGSSFLTGGKRGATALASGVGTGAQRVGRKTLIVAAAAAQPKKSWIPAVKGGGNFLDPEWLDGSLPGDFGFDPLGLGKDPAFLKWYREAELIHGRWAMAAVLGIFVGQAWSGVAWFEAGAQPDAIAPFSFGSLLGTQLLLMGWVESKRWVDFFNPDSQSVEWATPWSKTAENFANYTGDQGYPGGRFFDPLGLAGKNRDGVYEPDFEKLERLKLAEIKHSRLAMVAMLIFYFEAGQGKTPLGALGL

SEQ ID NO: 27933 - protein, 115 aa, Oryza sativa
MAVAIEAPFHVLAVDDSLPDRKLIERLLKTSSFQVTTVDSGSKALEFLGLHDHEDSPISTQSDQQEVGVNLIITDYCMPGMTGYDLLKKIKESSYLRDIPVVIMSSDNIPSRINR

SEQ ID NO: 27934 - protein, 516 aa, Escherichia coli
MFMATYMTFSLKQSGRAMSKHDTDTSDQHAAKRRWLNAHEEGYHKAMGNRQVQMIAIGGAIGTGLFLGAGARLQMAGPALALVYLICGLFSFFILRALGELVLHRPSSGSFVSYAREFLGEKAAYVAGWMYFINWAMTGIVDITAVALYMHYWGAFGGVPQWVFALAALTIVGTMNMIGVKWFAEMEFWFALIKVLAIVTFLVVGTVFLGSGQPLDGNTTGFHLITDNGGFFPHGLLPALVLIQGVVFAFASIEMVGTAAGECKDPQTMVPKAINSVIWRIGLFYVGSVVLLVMLLPWSAYQAGQSPFVTFLSKLGVPYIGSIMNIVVLTAALSSLNSGLYCTGRILRSMAMGGSAPSFMAKMSRQHVPYAGILATLVVYVVGVFLNYLVPSRVFEIVLNFASLGIIASWAFIIVCQMRLRKAIKEGKAADVSFKLPGAPFTSWLTLLFLLSVLVLMAFDYPNGTYTIAALPIIGILLVIGWFGVRKRVAEIHSTAPVVEEDEEKQEIVFKPETSS

SEQ ID NO: 27935 - protein, 295 aa, Unknown
  Rhizobium sp. USDA 3876
RGKTQIKEFAEFPDLEQLPLWGFDGSSTQQAEGHSSDCVLKPVAVYPDPARTNGVLVMCEVMMPDGVTPHASNKRATILDDEGAWFGFEQEYFFYKDGRPLGFPESGYPAPQGPYYTGVGYSNVGSVARQIVEEHLDLCLAAGINHEGINAEVAKGQWEFQIFGKGSKKAADQMWMARYLMQRLTEKYGIDIEYHCKPLGDTDWNGSGMHANFSTAYMREVGGKAYFEALMAAFDKNLMDHIAVYGPDNDKRLTGKHETAPWNRFSYGIADRGASIRVPHSFIKSDYKGYLEDRL

SEQ ID NO: 27936 - protein, 112 aa, Mycobacterium avium
MKLITAIVKPFTLDDVKTSLEDAGVLGMTVSEIQGYGRQKGHTEVYRGAEYSVDFVPKVRIEVVVDDSIVDKVVDSIVRAARTGKIGDGKVWVSPVETIVRVRTGERGTDAL

SEQ ID NO: 27937 - protein, 362 aa, Burkholderia xenovorans
MATPQFHPLRIREVRPETADAVSVAFEVPAELREQYRFTQGQFVTLKTHIDGEETRRSYSICVGVTDYDRDGELRIGIKRVRGGRFSNFAFDTLQPGHTIDVMTPDGRFFTHLNADQGQQYLAFSGGSGITPVLAIIKTTLEVEPRSTFTLVYGNRSVDQIMFAEELEDLKNRFMNRFVLYHVLSDDLQDVELFNGVLDQEKCAAFIENLLPADAIDEAFICGPAPMMDAAEAALKAAGVPPEKVHVERFGSPLPQAGVPQIEITEDTPAADLEIVLDGKRRKLRLPYQGVSVLDVGLRAGLALPYACKGGVCCTCRAKVLEGEVKMEKNYTLEEHEIRDGFVLTCQCHPVSDRVVVSYDER

SEQ ID NO: 27938 - protein, 284 aa, Unknown
  Rhizobium sp. USDA 3883
  misc_feature (279)..(279): Xaa can be any naturally occurring amino acid
RGKTQIKEFAEFPTLEQLPLWGFDGSSTQQAEGHSSDCVLKPVAVYPDPARTNGVLVMCEVMMPDGVTQHASNKRATILDDEGAWFGFEQEYFFYKDGRPLGFPESGYPAPQGPYYTGVGYSNVGSVARQIVEEHLDQCLAAGINHEGINAEVAKGQWEFQIFGKGSKKAADQMWMARYLMQRLTEKYGIDIEYHCKPLGDTDWNGSGMHANFSTSYMREVGGKAYFEALMAAFDKNLMDHIAVYGPDNDKRMTGKHETAPWNKFSYGIADRGASIRVXHSFIK

SEQ ID NO: 27939 - protein, 615 aa, Oryza sativa
MAASSSSTSFSSSSSHEGDAGSSYIECFKYSRRATLRSVVGRPDGGAGLVGERAVVGGWVRSSAVVRARRAAAGPASPSRKPEVEATGLTCTEVLMSRVPLIRCIARLMAGGITAAASAGGSARRPAVGTALVRINDGSCVSDLQIVVDSALLPLDQINATGACVLVEGKIEQVEGTLPQYVVQMKVEKILHIGPVDSEKYPRSNAHSSPDLVRGYPHLAARTATVASTARVRSELVHAVHAFFQSNGFFHVNTPTITTTTATSAGNRGKMLRLTRLFSKSDNGNRITPEAVRAAIKEKTKQVEALKRSESNREALEAAEQDLQRANALSRQLEQGASAESSQDEFFHRPAYLTPCHTLHLETYACALSSVYTFSPVFQAESESLDSDRSLAERWTVDVELAFAELEDAISCAEDCVKSLCSTVSKDCSDELKFLSSNQAGDATSSVIEAAVSSPWQKIKYTEAVNTLLQVTDKTFESKLELGMPLSREHLSYLADDLYKKPVIIYDYPKQLKPFYARLKEDLKTVSAFDLVVPKVGIVACGAQKEERMDNLTSRIEESGLQVEQLEWYLDTRRHGTVKHSGFSIDLESLILFVTGLKDVRDAIPFHRTKGHAKC

SEQ ID NO: 27940 - protein, 725 aa, Oryza sativa
VEAVVMPERYALGGACRVLAGMPAPLGATALDGGVNFAVYSAGASAASLCLFTPDDLEADEVTEEVPLDPLFNRTGNVWHVFIEGELHNMLYGYRFDGMFAPHCGQYFDVSNVVVDPYAKAVISRGEYGVPGPGGDCWPQMAGMIPLPYSTFDWQGDLPLRYPQKDLVIYEMHLRGFTKHSSSNVEHPGTYIGAISKLDYLKELGVNCVELMPCHEFNELEYFSCSSKMNFWGYSTINFFSPMIRYSSGGIRNCGRDAINEFKTFVREAHKRGIEVIMDVVFNHTAEGNEKGPILSFRGIDNSTYYMLAPKGEFYNYSGCGNTFNCNHPVVREFIVDCLRYWVTEMHVDGFRFDLASIMTRGCSLWDPVNVYGSPVEGDMTTTGTPLATPPLIDMISNDPILGDVKLIAEAWDAGGLYQVGQFPHWKIWSEWNGKYRDIVRQFIKGTDGFAGGFAECLCGSPHLYQAGGRKPWHSINFVCAHDGFTLADLVTYNKKYNSSNGEDNRDGENHNLSWNCGEEGEFAGLSVKRLRKRQMRNFFVSLMVSQGVPMFYMGDEYGHTKGGNNNTYCHDHYVNYFRWDKKEESSDLQRFCSLMTKFRKQCESLGLADFPTAQRLHWHGHQPGKPDWSETSRFVAFSTKDETKGEIYVAFNASHLPAVVGLPERPGYRWEPLVDTGKPAPYDFLTDDLPDRAHAVHLFSHFLNSNLYPMLSYSSIILELQPDD

SEQ ID NO: 27941 - protein, 356 aa, Escherichia coli
MMSQKYLFIDRDGTLISEPPSDFQVDRFDKLAFEPGVIPELLRLQKAGYKLVMITNQDGLGTQSFPQADFDGPHNLMMQIFTSQGVQFDEVLICPHLPADECDCRKPKVKLVERYLAEQAMDRANSYVIGDRATDIQLAENMGINGLRYDREILNWPMIGEQLTKRDRYAHVVRNTKETQIDVQVWLDREGGSKINTGVGFFDHMLDQIATHGGFRMEINVKGDLYIDDHHTVEDTGLALGEALKIALGDKRGICRFGFVLPMDECLARCALDISGRPHLEYKAEFTYQRVGDLSTEMIEHFFRSLSYTMGVTLHLKTKGKNDHHRVESLFKAFGRTLRQAIRVEGDTLPSSKGVL

SEQ ID NO: 27942 - protein, 256 aa, Prosthecochloris aestuarii
MEEKISKFIIQSFFAKLEDSLTVDVAIVGAGPSGLIAAKELAKAGKKVAIFESKLAPGGGVWGGGMLFNEIVLQENIIPILDEYAIRYKTTGEGYVTADAVEVSSALIYGAVHAGVRIFNAVRVEDLAMRDERVCGVVINWNPVSRLEMHVDPLVITSRAVLDGTGHPSELINLASKKAGITLDTPTGKVMGEKPMWMENGESSTVINTKRLYPGLYASGMAANNAMGGFRMGPIFGGMFLSGKKVAGLILEDIQG

SEQ ID NO: 27943 - protein, 489 aa, Escherichia coli
  misc_feature (57)..(57): Xaa can be any naturally occurring amino acid
MVSETKTTEAPGLRRELKARHLTMIAIGGSIGTGLFVASGATISQAGPGGALLSYMXIGLMVYFLMTSLGELAAYMPVSGSFATYGQNYVEEGFGFALGWNYWYNWAVTIAVDLVAAQLVMSWWFPDTPGWIWSALFLGVIFLLNYISVRGFGEAEYWFSLIKVTTVIVFIIVGVLMIIGIFKGAQPAGWSNWTIGEAPFAGGFAAMIGVAMIVGFSFQGTELIGIAAGESEDPGKNIPRAVRQVFWRILLFYVFAILIISLIIPYTDPSLLRNDVKDISVSPFTLVFQHAGLLSAAAVMNAVILTAVLSAGNSGMYASTRMLYTLACDGKAPRIFAKLSRGGVPRNALYATTVIAGLCFLTSMFGNQTVYLWLLNTSGMTGFIAWLGIAISHYRFRRGYVLQGHDINDLPYRSGFFPLGPIFAFILCLIITLGQNYEAFLKDTIDWGGVAATYIGIPLFLIIWFGYKLIKGTHFVRYSEMKFPQNDKK

SEQ ID NO: 27944 - protein, 586 aa, Bacillus acidopullulyticus
MFREAIYHRPKDNYAYACANGELHIRIRTKKDDMKEVTLVYGDTYEFDDNKWTYSTAHMKKTGSDQLFDYWLASVTPRYKRLRYGFIVNDRKDSTCFTEKGFYPEPPVNDISYYFSFPYVNQADIFQAPEWVKDTVWYQIFPERFANGNKDNDPDGTLPWGSREPEIDNFFGGDLEGVIEHIDYLKELGIGGIYFTPIFKAHSNHKYDTIDYMEIDPQFGTKETLKKLIDVCHKNGIKVMLDAVFNHSGVFFPPFQDVVEKGKNSKYQDWFHIREFPLVMEPRPNYDTFGFTSSMPKFKTENPEVKEYLLEVGRYWVREFDIDGWRLDVANEVSHAFWREFRREVKAIKPDLYILGEIWHDSLPWLRGDQFDAVMNYPLSTNIVNLFANQSVSVKEFVENMSHVIHMYPDTVNEAAFNLVGSHDTPRILTQCGEDVERLKQVFVLLLTFIGTPCIYYGDEIGLTGGQDPGCRKCMEWNPDQQNRELLQHVRKLIQLRSENPLLANEGELTFVPPKNEEDPCLAYTKSNEEKTIMIIINKSKNSVEYPLSFDAAEQTVKNLWNQEQLILQNGQTLELKANDFKILEF

SEQ ID NO: 27945 - protein, 206 aa, Glycine max
RLREDDRRGFTVSEKEEEKKDERRRKTTRWKSVAAAAKRPSASSPLSPSPRTRRSRKDMSVTAASEPVDREKTCPLLLRVFTKIGSHHSMEDFAVRGKEPKDEVQIYTWKDATLRELTDLVKEVAPAARRRNAKLSFAFVFPDKNGRFKVQEVGKTLSYGNGRLDDGKALAELGFEVKDFFSSLLEFMLDLFTNSVADPVRKCADR

SEQ ID NO: 27946 - protein, 226 aa, Magnetospirillum magnetotacticum
ASVRTNYWGYSTLGFFAPHAAYATRAAQDAGPAAVLDEVRGMVHLLHEAGIEVLLDVVHNHTCEGGADGYHLSWRGLDNAGYYLHDGGTPARLADVTGTGNSLDYRRPAVVRAALDSLRYWAEVVGVDGFRFDLAVTLGRGATGFDPDHPFLVALQTDPVLCGLKLVAEPWDVGPGGWRTGQFPPPLAEWNDRFRDAARQFWLADAREASHGRPGHGVRDLATRLA

SEQ ID NO: 27947 - protein, 153 aa, Magnetospirillum magnetotacticum
MARYLLQRLCEKYEIDIEYHCKPLGDTDWNGSGMHCNFSTTFMRETGGKDYFEAMMAAFERNLEDHMAVYGPDNHMRLTGKHETAPWNKFSYGVADRGASVRVPHSFVNNGYKGYLEDRRPNSMGDPYQIASQVLKTISEVPLPSEAAQKAVA

SEQ ID NO: 27948 - protein, 398 aa, Cucumis sativus
MALQAASLVSPALSIPKEGKSSVCLKDSSLFGISFSDHLKSEFSSSTLRCKRELNQQIGAIRAQTTATESPAVNKATPDGKKTLRKGSVVITGASSGLGLATAKALAETGKWHVIMACRDFLKAERAAKSAGITKENYTVMHLDLASLDSVRQFVDNFRQSGRPLDVLVCNAAVYLPTAKEPTFTAEGFELSVGTNHLGHFLLSRLLLEDLNKSSYPSKRLIIVGSITGNTNTLAGNVPPKANLGDLRGLAGGLNGLKSSMIDGGEFDGAKAYKDSKVCNMLTMQEFHKRYHEETGITFASLYPGCIATTGLFREHIPLFRILFPPFQKFITQGYVSEDEAGKRLAQVVSEPSLTKSGVYWSWNKNSASFENQLSQEASDAEKARKVWELSEKLVGLA

SEQ ID NO: 27949 - protein, 620 aa, Zea mays
MAALATSQLVATRAGLGVPDASTFRRGAAQGLRGARASAAADTLSMRTSARAAPRLQLHQQQQQARRGARFPSLVVCASAGMNVVFVGAEMAPWSKTGGLGDVLGGLPPAMAANGHRVMVVSPRYDQYKDAWDTSVVSEIKMGDRYETVRFFHCYKRGVDRVFVDHPLFLERVWGKTEEKIYGPVAGTDYRDNQLRFSLLCQAALEAPRILSLNNNPYFSGPYGEDVVFVCNDWHTGPLSCYLKSNYQSHGIYRDAKTAFCIHNISYQGRFAFSDYPELNLPERFKSSFDFIDGYEKPVEGRKINWMKAGILEADRVLTVSPYYAEELISGIARGCELDNIMRLTGITGIVNGMDVSEWDPSRDKYIAVKYDVSTAVEAKALNKEALQAEVGLPVDRNIPLVAFIGRLEEQKGPDVMAAAIPQLMEMVEDVQIVLLGTGKKKFERMLMSAEEKFPGKVRAVVKFNAALAHHIMAGADVLAVTSRFEPCGLIQLQGMRYGTPCACASTGGLVDTIIEGKTGFHMGRLSVDCNVVEPADVKKVATTLQRAIKVVGTPVYEEMVRNCMIQDLSWKGPAKNWENVLLSLGVAGGAGPLISRVVQRCWDIFLYMLFRLCDMDKYV

SEQ ID NO: 27950 - protein, 353 aa, Salmonella typhimurium
SQKYLLIDRDGTLISEPPSDFQVDRFDKLAFEPEVIPVLLKLQKAGFKLVMITNQDGLGTQSFPQADFDGPHNLMMQIFTSQGVSFDEVLICPHLPADDCDCRKPKVKLVERYLAEQAMDSANSYVIGDRATDIQLADSMGITGLRYHRETLNWTMIGEQLTKRDRYAHVVRNTKETQIDVSVWLDREGNSKINTGVGFFDHMLDQIATHGGFRMEITVKGDLYIDDHHTVEDTGLALREALKLALRDKRGICRFGFVLPMDECLACALDISGRPHLEYKAEFTYQRVGNLSTEMIEHFFRSLSYTMGVTLHLKTKGKNDHHRVESLFKAFGRTVRQAIRVEGDTLPSSKGVL

SEQ ID NO: 27951 - protein, 520 aa, Coprinopsis cinerea
MRYLTRALTSIVLASFSVNAWAFRPGDGGYRQELLHPNLGFPTLYNDGLFTPFEDLSTLSETDFTTLTHPAFPRHSVRIKQTKFCDNTVRAYTGYIDIGPRHLFFYFFESRSRPNKDPVVLWTNGGPGCSSSLGLFMELGPCRVTDANTTTFHKESWNNNANIFFIDQPIGVGFSYADYGEAVGTSEEAAGDIAGFVRMFFEHFSEFRGRPFHLAGESYAGRYLPIFAAYIYDQNVELKKHGIAPINLTSVMIGNGYTHPNTMVESYYDMACTVTEARGPPVLGVRECVRMKQAQIRCKKWMEKACMEPTFDELGCAAAASFCQVELGAPLIASGKNPYDLSRECDGTIEDTLCYPISKKISAYLDKPDVRKLIGVDPSLKNRNFSSCSDKVSNDFVVRLDPLRSTDHYVAALLEHGIKVLIYVGVNDWICNYIGNSRWVSDLDWSGREGYGNAVTRDWYTSASFTESSLKRKLVKAGTVREYGGLTFLTIDGAGHMAPYDKPEELLDMASRWLDGRKFT

SEQ ID NO: 27952 - protein, 183 aa, Xanthomonas campestris
MSQTLYDIPVTRIDGQPTTLADYRGKVLLVVNVASKCGLTPQYEGLEALYRDKRMQGLEVLGFPANDFNAQEPGSEAEIAQFCQLTYDVTFPMFAKIAVTGDQAHPLYRALTSTHPHTTGDGPMREKLAGYGIAPNPAPGVVWNFEKFLIGRDGKIVDRFAPDIPADDARLRAAVDAALATHA

SEQ ID NO: 27953 - protein, 123 aa, Brassica napus
MAKYNEIAKKKREAKADRKRAIHGDPLTNKLKTRAPVVAVSGKRQKKLLRKWRREQKEMVEKGIVTMEDVEMASAEAGSEDSKKPTRKFSVKKTIKLNKLKNKGNKKKSQRAGGKVSTDQMLE

SEQ ID NO: 27954 - protein, 450 aa, Arabidopsis thaliana
MANQNLKYEMANKYVSSVLKSLLVLLHLVFLSKQHVDSASIVKSLPGFEGQLPFELETGYIGVGEEEEVQLFYYFIKSERNPKEDPLILWLTGGPGCSAISGLLFENGPLTMKLDVYNGTLPSLVSTTYSWTKTSSIIFLDQPVGTGFSYSRTQQFNKPSDSGEAKRIHEFLQKWLGKHQVFSSNPFYVAGDSYSGLVVPATVQEISKGNYECCNPPINLQGYVLGNPLTDYTTGSNSRIPFAHGMALISDELYESLKKTCKGEYTNVHPRNTQCLKFVEEFNKCTNRIFQQLILDPLCETETPDCYIYRYLLTTYWANDATVREALQINKESIGEWVRCYYSIPYNNDIKSSMPYHVNNSISGYRSLIYSGDHDFEVPYLGTQAWIRSLNYSIIDDWRPWMVKNQIAGYTRTYANKMTFATIKGGGHTAESKPEEASIMFQRWINGQPL

SEQ ID NO: 27955 - protein, 97 aa, Arabidopsis thaliana
  misc_feature (31)..(31): Xaa can be any naturally occurring amino acid
  misc_feature (37)..(37): Xaa can be any naturally occurring amino acid
  misc_feature (39)..(39): Xaa can be any naturally occurring amino acid
  misc_feature (43)..(43): Xaa can be any naturally occurring amino acid
  misc_feature (47)..(47): Xaa can be any naturally occurring amino acid
  misc_feature (49)..(49): Xaa can be any naturally occurring amino acid
  misc_feature (56)..(57): Xaa can be any naturally occurring amino acid
  misc_feature (60)..(60): Xaa can be any naturally occurring amino acid
  misc_feature (62)..(63): Xaa can be any naturally occurring amino acid
  misc_feature (65)..(65): Xaa can be any naturally occurring amino acid
MASSMLSSATMVASPAQATMVAPFNGLKSSXAFPATXKXNNDXTCMXSXGGRVNCXXVWXAXXKXKGLVWIGGPLSPFRAPVAWVVSDAKARGEGTA

SEQ ID NO: 27956 - protein, 222 aa, Nicotiana tabacum
MTHLKKSYLLPSKILSLLCLFAFAEEFLLFYLQRKDPSGVENRYYDLLLVPITICAFCSILELKNPKLKYAKLGRGIGLILQGMWILQMGFSFFSDLIAQGCSLHEKSRGNYTVKCKGHPEYHRGRAIATLQFNCHLALLVTVIAFVYSIVCKKNGIGPEHMRYRPIGAEMQHLEMDSQGHFTLESDEDDDENGIKEERNVEMQKAIVTAPESGTNGYHTHP

SEQ ID NO: 27957 - protein, 581 aa, Aspergillus oryzae
MSSSKSEDYKVGAYIGYRMEELGVSDYFVVPGDTNLTLLDSLLENPRLRMVECCNELNTGYAADGYARASECKTAVAVIPYIVGGLSILNAISGACSERLKVIVISGCPPTSVLTSSKPTHHTPSPTNKDVALHAFQGVTAASVRVNTAESATDVIDNAIIKCIQQSLPVYIELPNDIAGAPCPFPIPFTRKVEEATQLNRNGEALEAVTDLWNSSHRPVLLLGSQARVSLPRDIVQRLSEKLGCPVLCQPDGRWLSESHPQYWCTFWPGLLNPEGEKLVLDSDLWLAIGVSWSDLHTHSIDPKEENHRLIALQHDGVELPEDKVISPVNLRELVSAMIDSNIIRRSESLPSSKPSHPAGIQTEIKTSDDALTVRSLLSGVQAMLQENSKLVVDTGDTWFAASHVELPDGVDIYMQLPYASIGWSVPATLGAQVAHPHGRVVLMVGDGAFQMTAQEISTMVRMKLNPIIFLFNNLGYKTETAVHEGSYNYIANWDYTKLATSFLDKPHAHPPSPYATDKPGDDEMPVFAEKVRTQADLLRAMERVSAESDKLAFLECCIQPDNMTPELRALGEKVSKGVSK

SEQ ID NO: 27958 - protein, 296 aa, Unknown
  Rhizobium sp. USDA 4004
RGKTQIKEFAEFPTLEQLPLWGFDGSSTQQAEGHSSDCVLKPVAVYPDPARTNGVLVMCEVMMPDGVTPHASNKRATILDNKGAWFGFEQEYFFYKDGRPLGFPESGYPAPQGPYYTGVGYSNVGSVARQIVEEHLDQCLAAGINHEGINAEVAKGQWEFQIFGKGSKKAADQMWMARYLMQRLTEKYGIDIEYHCKPLGDTDWNGSGMHANFSTAYMREVGGKGYFEALMAAFDKNLMDHIAVYGPDNDKRLTGKHETAPWNRFSYGIADRGASIRVPHSFINNGYKGYLEDRRP

SEQ ID NO: 27959 - protein, 297 aa, Unknown
  Rhizobium sp. USDA 4007
RGKTQIKEFAEFPTLEQLPLWGFDGSSTQQAEGHSSDCVLKPVAVYPDPARTNGVLVMCEVMMPDGVTPHASNKRATILDDEGAWFGFEQEYFFYKDGRPLGFPESGYPAPQGPYYTGVGYSNVGSVARQIVEEHLDQCLAAGINHEGINAEVAKGQWEFQIFGKGSKKAADQMWMARYLMQRLTEKYGIDIEYHCKPLGDTDWNGSGMHANFSTAYMREVGGKAYFEALMAAFDKNLMDHIAVYGPDNDKRLTGKHETAPWNKFSYGIADRGASIRVPHSFIKNDYKGYLEDRRPN

SEQ ID NO: 27960 - protein, 1041 aa, Bordetella parapertussis
MKRMLFNATHQEELRVAIVDGQKLIDLDIETAGREQRKGNIYKGVITRIEPGLEACFVNYGEDRHGFLPFKEVARSFFKEGVDVRTARIQDALREGQELIVQVEKEERGNKGAALTTFISLAGRYLVLMPNNPRGGGVSRRVEGEDRQELRDTMEQLDVPQGMSIIARTAGIGRNVDELQWDLSYLLQLWTAIDGAARDNAAPILIYLESSLVIRAIRDYFSPEIGEILIDTDEIADQATAFMSVVMPDNVQRVKRYRDDIPLFSRFQIEHQIETAYSRTVQLPSGGAVVIDHTEALVAVDVNSARSTRGADIEETALRTNLEAAEEVARQLRLRDLGGLIVIDFIDMEDRKNQRAVEQRLRDALHFDRARVQMGKISRFGLMELSRQRLRPALNEGSHITCPRCNGTGVIRDAESSALHVLRLLQEEAMKENTAAVHAQVPVDVATFLLNEKRADITKMEARLKVNLVLIPNKHLETPHHHIERLRHDDPRLEKSKTSFELAEAPATDLTWQPREHEIKARPEALVKGITPAQPAPVSTPAPAKAPAAAAATQGGLGGWFKRLTSWLGGSAEPAKTETKSEDEKRGANRARRAHDGQDRRGERHGSDRNRHRRNEPRGDHAESGDARHHVRGGRRQEERGERGERGQKEARAEREQTQQQQAAGQPRQERPSTAETGEEGGRGRGRRGRGRGRREEGQTDTPMTEQENMVAALAETVAAALPEKRQAAPAPAAAAAAALTVAEAASSNELAPVAEDADGIDGIDANVDAGAETGTDPERKRRRRRSRRGRRSQEDGSTVNAEGVEGADDEQVDAPAGVADIETPAQPAESETVAAPVAVSVAADEPAATIETAAAEPTAPQATEAPRAEPVVAAADTAPQAVQPVQAELTPVETPQAQAQPAEPAAAAPVETAPVETAPVETAPVETAPAATTPVEPAEQAAAPVEAEAPVAQPEKTPEPAAVRPAEAIVVPAQAAAPATGALHDVLDAAGLTWVETDPERHAQTQMRIAAAAAPVRLGRERKPVASVSNEPLVQVETRH

SEQ ID NO: 27961 - protein, 414 aa, Thermus thermophilus
MVKVEVLGMILAGGQGSRLYPLTAKRAKPAVPFGAKYRIIDFVLNNFVNSGIYAIYVLTQYKAQSLTEHIQRYWRFGAFLEDHFILLVPAQMYRYEELGPVWYRGTADAIYQNLHLVHNHAPKAVAVFGGDHIFKMNIRHMVEYHYDTRADITIAAYPVPVAEATRFGVLQVDEEWRITEFQEKPEEPKPIPGRPDMALASMGNYIFRTEALFELLEADARDETSAHDFGKDVIPRALREGYRVYAYDFHRNPIPGQEGPNLYWRDVGTLDAYYEASMDLVKVVPEFDLFNPEWPLRTANLFSPPAKFVHETGERVGRALNSLLAGGVIVSGGTVRESVLFRRVRVNSYSLVERSVLFDDVEVGRYCRIRNAIIDKNVKIPPHTEIGYDLELDRARGFTVTPEGVVVVPKGYRF

SEQ ID NO: 27962 - protein, 297 aa, Unknown
  Rhizobium sp. CIAM0128
RGKTQIKEFAEFPTLEQLPLWGFDGSSTMQAEGHSSDCVLKPVAVYPDPARTNGVLVMCEVMMPDGVTPHASNKRATILDDEGAWFGFEQEYFFYKDGRPLGFPESGYPAPQGPYYTGVGYSNVGSVARQIVEEHLDLCLAAGINHEGINAEVAKGQWEFQIFGKGSKKAADQMWMARYLMQRLTEKYGIDIEYHCKPLGDTDWNGSGMHANFSTAYMREVGGKAYFEALMAAFDKNLMDHIAVYGPDNDKRLTGKHETAPWNRFSYGIADRGASIRVPHSFIKSDYKGYLEDRRPN

SEQ ID NO: 27963 - protein, 557 aa, Unknown
  Acinetobacter sp. ADP1
MNKNIEQFPRKTTLTPQQKLEQLMEQHKTVHLTELFDKEQDRFAKYCVGCEDLVFDFSKQRINQPILDALVQLAESKQLNKWIDTLFSQNKINYTEQREAMHWALRLPADNQVYPELAKQVSDQLERMYQLVNKIHEGQYRGATGEVIQDVVNIGVGGSDLGPLMVSHALSDFKVKTAKPLNIRFVSTMDGSQLSDILHQLRPETTLFIVSSKSFSTIDTLSNAHTARKWLEKALGRESSILKSHFIGVSTKPDKMTEWGIHPDNQFLLWDWVGGRYSLWSCIGLPIALTIGVEGFKAFLAGAHGIDEHFRTTEFHQNIPVLMGLMGIWNTNYLNLKTHAVLPYDGRLKYFTSYLQQLEMESNGKSTQRNGQKVENTTCPIVWGEVGPNAQHAFYQLLHQGTQKVSCDFIAPMHRYNANHFTYVENADALIDQHLLALSNCLAQSRLLAFGNDALKVDQREQLPAYKQYEGNQPSTTMLLKELSPRTMGKLIALYEHKVFVQSVIWDINPFDQWGVEKGKEIANDLLPILNGESSDLSHLDDSTQGLIQFLLGKSNG

SEQ ID NO: 27964 - protein, 483 aa, Thiobacillus denitrificans
MLIFDHSRPGRTAAAQLPATGGDLGDLPAELRRKDAPALPEVSELDVVRHYTRLSQKNFSIDTQFYPLGSCTMKYNPRACNSLAMLPQFLARHPASPDETGQGFLASMFELQEMLKDVTGMAGVSMAPMAGAHGEFAGVAMIRAYHDAKGDAARREIIVPDAAHGTNPATATMCGYTVKEIPTDATGAVDLAALKAAVGPQTAGLMLTNPSTLGVFEKTIAEIQKIVHDAGGLLYYDGANLNAILGKVRPGDMGFDVIHMNLHKTFSTPHGGGGPGAGPVGVSGRLLPFMPIPLVLNDNGFYRLATEADLPQSIGRMSANMGNAGVLMRAYVYARLLGREGMHRVAEYATLNANYLMAKLREAGFDLAYPTRRASHEFIVTLKKLKDATGVSAMDFAKRLLDYGYHAPTTYFPLLVPECLLIEPTETESRETLDGFVDAMKTIKHEAETNPDLVKGAPYTLPVRRLDDVKAARELDLAYKPAA

SEQ ID NO: 27965 - protein, 290 aa, Saccharomyces cerevisiae
TLVHVASVEKGRSYEDFQKVYNAIALKLREDDEYDNYIGYGPVLVRLAWHISGTWDKHDNTGGSYGGTYRFKKEFNDPSNAGLQNGFKFLEPIHKEFPWISSGDLFSLGGVTAVQEMQGPKIPWRCGRVDTPEDTTPDNGRLPDADKDAGYVRTFFQRLNMNDREVVALMGAHALGKTHLKNSGYEGGGANNVFTNEFYLNLLNEDWKLEKNDANNEQWDSKSGYMMLPTDYSLIQDPKYLSIVKEYANDQDKFFKDFSKAFEKLLENGITFPKDAPSPFIFKTLEEQGL

SEQ ID NO: 27966 - protein, 297 aa, Unknown
  Rhizobium sp. CIAM2026
  misc_feature (82)..(82): Xaa can be any naturally occurring amino acid
  misc_feature (91)..(91): Xaa can be any naturally occurring amino acid
RGKTQVKEFAEFPTLEELPLWGFDGSSTMQAEGHSSDCVLKPVAAYPDPTRTNGVLVMCEVMMPDGVTPHASNKRATILDDXGAWFGFEQXYFFYKDGRPLGFPETGYPAPQGPYYTGVGYKNVGDVARQIVEDHLDLCLAAGINHEGINAEVAKGQWEFQIFGKGSKKAADQMWIARYLLLRLTEKYRIDIEFHCKPLGDTDWNGSGMHANFSTAYMREVGGKAYFESLMAQFDKNLMDHIAVYGPDNDKRLTGKHETAPWNKFSYGIADRGASIRVPHSFVKNDYKGYLEDRRPN

SEQ ID NO: 27967 - protein, 289 aa, Saccharomyces cerevisiae
LVHVASVEKGRSYEDFQKVYNAIALKLREDDEYDNYIGYGPVLVRLAWHISGTWDKHDNTGGSYGGTYRFKKEFNDPSNAGLQNGFKFLEPIHKEFPWISSGDLFSLGGVTAVQEMQGPKIPWRCGRVDTPEDTTPDNGRLPDADKDAGYVRTFFQRLNMNDREVVALMGAHALGKTHLKNSGYEGGGANNVFTNEFYLNLLNEDWKLEKNDANNEQWDSKSGYMMLPTDYSLIQDPKYLSIVKEYANDQDKFFKDFSKAFEKLLENGITFPKDAPSPFIFKTLEEQGL

SEQ ID NO: 27968 - protein, 391 aa, Rhizobium leguminosarum
MRRIHHFRNFAIGAVALLWSAQVGSADAQSSAQPSFVTTKEGGFLLDGKPFRVAGVNNHYLTFGSSGEVTRVLDDATAMGANVVRTFLQPVIGSLDGRVPTIWNSKSTADSSNLGTKGIYMMSWDPITNKMVPNDGPDGLQKVDYLIAEAAKRKLRLILAFVDFWAYTGGAQQMNAWYGSSDKYTFFAADPRTRRDYKAWVGHVLSRVNTITGVRYSDDPTIFAWDLANEPDIHPKPLLHEWVSEMSAYVKSLAPKQLVTTGHGNMDQKLADMNIPSVDFGTWHGYPSYVKMSHSDFDARIREYCAIGRNIGKPVILEEFGIPRSDADQANAYGTWLNTIATSDCGGWVVWRLTSTQDSGLYPQDDYDKFDIHNDGSPAWQALRDAALKLQ

SEQ ID NO: 27969 - protein, 297 aa, Unknown
  Rhizobium sp. CIAM2032
RGKTQVKEFAEFPTLEELPLWGFDGSSTMQAEGHSSDCVLKPVAVYPDPTRTNGVLVMCEVMMPDGVTPHASNKRATILDDEGAWFGFEQEYFFYKDGRPLGFPETGYPAPQGPYYTGVGYKNVGDVARQIVEDHLDLCLAAGINHEGINAEVAKGQWEFQIFGKGSKKAADQMWIARYLLLRLTEKYRIDIEFHCKPLGDTDWNGSGMHANFSTAYMREVGGKAYFESLMAQFDKNLMDHIAVYGPDNDKRLTGKHETAPWNKFSYGIADRGASIRVPHSFIKNDYKGYLEDRRPN

SEQ ID NO: 27970 - protein, 720 aa, Arabidopsis thaliana
MKSLHVAANAGDLAEDCGILGGDADDTVLMDGIDEVGREIWLDDHGGDNNHVHGHQDDDLIVHHDPSIFYGDLPTLPDFPCMSSSSSSSTSPAPVNAIVPSASSSSAASSSTSSAASWAILRSDGEDPTPNQNQYASGNCDDSSGALQSTASMEIPLDSSQGFGCGEGGGDCIDMMETFGYMDLLDSNEFFDTSAIFSQDDDTQNPNLMDQTLERQEDQVVVPMMENNSGGDMQMMNSSLEQDDDLAAVFLEWLKNNKETVSAEDLRKVKIKKATIESAARRLGGGKEAMKQLLKLILEWVQTNHLQRRRTTTTTTNLSYQQSFQQDPFQNPNPNNNNLIPPSDQTCFSPSTWVPPPPQQQAFVSDPGFGYMPAPNYPPQPEFLPLLESPPSWPPPPQSGPMPHQQFPMPPTSQYNQFGDPTGFNGYNMNPYQYPYVPAGQMRDQRLLRLCSSATKEARKKRMARQRRFLSHHHRHNNNNNNNNNNQQNQTQIGETCAAVAPQLNPVATTATGGTWMYWPNVPAVPPQLPPVMETQLPTMDRAGSASAMPRQQVVPDRRQGWKPEKNLRFLLQKVLKQSDVGNLGRIVLPKKEAETHLPELEARDGISLAMEDIGTSRVWNMRYRFWPNNKSRMYLLENTGDFVKTNGLQEGDFIVIYSDVKCGKYLIRGVKVRQPSGQKPEAPPSSAATKRQNKSQRNINNNSPSANVVVASPTSQTVK

SEQ ID NO: 27971 - protein, 464 aa, Thiobacillus denitrificans
MPFIPHTEEDVSAMLGAIGAASIEDLFDEIPPALKTGKLKDVPDGLPEMAVARLMQERASQDGFWSNFIGAGVYEHHIPAAIWQITTRGEFYSAYTPYQAEASQGTLQLIYEYQTMMTRLTGLDVSNASLYDGASALAEAVLMAVRSHKSSRRVLVPKTVHPVYRSVVVTTVRNQGIDLVELEYDPATGKTVLPSEPGAFAGLVIPQPNFFGVLEDVHTMTDWTHANGGLAIALVNPTTLAVLEAPGKWGTKGADIAVGEGQPLGAPMASGGPYFGFMCCRQDFVRQMPGRIVGRTVDLDGKPGFALTLQAREQHIRRSKATSNICTNQGLVVTAATQYMALLGPQGLAKVAAASHANTVALAEKLGAIPGVARAFASPCFHEVVLKLDDGTLKGTSAKDVLRALRAQGILGGLDISGWYPELGQAILVCVTETKTGADLDHYAQHLERILSKRREAPPCAYKN

SEQ ID NO: 27972 - protein, 406 aa, Oryza sativa
MGSKKRSPQHPAAAAPPPAVGGGGGGEVSGDGGASTANGPVVPKPSEVAPFLTKVYDMVSDPATDNVISWAEGGGSFVIWDSHAFERDLHRHFKHSNFTSFIRQLNTYGFRKVHPDRWEWANEGFIMGQKHLLKTIKRRKKSSQEAPSEIQKAPVKTAPGTENIEIGKYGGLEKEVETLKRDKALLMQQLVDLRHYQQTSNLEVQNLIERLQVMEQNQQQMMALLAIVVQNPSFLNQLVQQQQQQRRSNWWSPDGSKKRRFHALEQGPVTDQETSGRGAHIVEYLPPVPETSGQVNPVEGAICSANSQPVPSPAVATPMDMQTSNVADTLGSSEEPFADNSTLHEWDDNDMQLLFDDNLDPILPPFENDGQMGPPLSVQDYDFPQLEQDCLMEAQYNSNNPQYGND

SEQ ID NO: 27973 - protein, 181 aa, Solanum tuberosum
MASSIVSSAAVATRSNVAQASMVAPFTGLKSAASFPVTKKNNNVDITSLASNGGRVRCMQVWPPINMKKYETLSYLPDLSDEQLLKEVEYLLKNGWVPCLEFETEHGFVYREHNSSPGYYDGRYWTMWKLPMFGCTDGTQVLAEVQEAKNAYPQAWIRIIGFDNVRQVQCISFIAYKPEGY

SEQ ID NO: 27974 - protein, 440 aa, Xanthobacter autotrophicus
MSDNQLPDTGRAAGNAVAPPLSRRRFLSVAGLGAGAAAAGAGALRPGPAVAAGPDPNIVPVPAWSKTLGPGVNVNPYGKPSKFEKDVVRREVTWLTASSESSVSFTPLYALDGVITPNGLCFVRHHGGEAEIDPDKYRFMIHGMVDKELVFTLDDIKRMPGRVNRAYFLECAANSGMEWRGAQLNGCQFTHGMIHNVFYTGVPLRAFLDMAGVKPKGKWVLAEGADAAVMTRSIPIEKALDDCLVAFAMNGEALRPEQGYPVRLVVPGWEGNMWIKWLRRIKVGDQPWQQREETSKYTDLLADGRSRRFTFIMDAKSVVTSPSPQAPLRQKGPNVLTGIAWSGRGSIKRVDVSLDGGRNWTTARLEGPVMPMAMTRFYLDFDWAGQELMVQSRAMDDTGYVQPTKNELRAVRGTNSIYHNNGIQTWLVRSNGETENVEVG

SEQ ID NO: 27975 - protein, 230 aa, Streptococcus suis
PWTDKDGNVQVNRGYRVQFNSAVGPYKGGLRFHPTVNQSILKFLGFEQIFKNVLTGLPIGGGKGGSDFDPKGKTDAEIMRFCQSFMTELQKHIGPSLDVPAGDIGVGGREIGYMYGQYKRLRQFDAGVLTGKPLGFGGSLIRPEATGYGLVYFTDNMLAANGKSFKDQTVLISGSGNVAQYAVQKATELGAKVISVSDSNGYIIDETGIDFDLLVDIKEKRRARLTEYAA

SEQ ID NO: 27976 - protein, 285 aa, Xanthomonas axonopodis
MSANDNWYIEHFQPTGSAIGFRISGKLDEVQSPFQKIEIYQTTDWGKLMLIDGAVMLTSRDNFFYHEMISHPALFTHPAPKRVVIIGGGDCGTLREVLKHPGVESATQCDIDEQVTRMSEKYFPELCDSNHDARAELLFDDGVAYMANCQAGSVDIVIVDSTDPVGPAEGLFNKAFYESCFKALKDDGILVQQSESPLALLDLINEMRTEMGKAGFQSFKTLPFPQPCYPTGWWSVTMASKQAKADFAFRQDAAQAKGFDTLYYTAHLHTGVLVAPPFVAKALGE

SEQ ID NO: 27977 - protein, 198 aa, Unknown
  Bradyrhizobium sp. CICS70
PTPNLRGKTQIKEFASFPTLEQLPLWGFDGSSTQQAEGHSSDCVLKPVAVFPDGARTNGVLVMCEVMMPDGKTPHASNKRATILDDAGAWFGFEQEYFFYKDGRPLGFPASGYPAPQGPYYTGVGFSNVGDVARKIVEEHLDLCLAAGINHEGINAEVAKGQWEFQIFGKGSKKAADEMWMARYLMLRLTEKYGIDIE

SEQ ID NO: 27978 - protein, 353 aa, Oryza sativa
MATTASSLLKTSFAGVRLPAAARNPTVSVAPRTGGAICNSISSSSSTPPYDLNAIRFSPIKESIVSREMTRRYMTDMITYADTDVVVVGAGSAGLSCAYELSKDPSVSVAVIEQSVSPGGGAWLGGQLFSAMVVRKPAHLFLDELGVAYDEQEDYVVIKHAALFTSTVMSRLLARPNVKLFNAVAVEDLIVKEGRVGGVVTNWALVSMNHDTQSCMDPNVMESRVVVSSCGHDGPFGATGVKRLQDIGMIDAVPGMRALDMNTAEDEIVRLTREVVPGMIVTGMEVAEIDGAPRMGPTFGAMMISGQKAAHLALKALGRPNAIDGTIKKAAAAAAAHPELILASKDDGEIVDA

SEQ ID NO: 27979 - protein, 233 aa, Bacillus anthracis
  misc_feature (78)..(78): Xaa can be any naturally occurring amino acid
MSVISMKQLLEAGVHFGHQTRRWNPKMKRYIFTERNGIYIIDLQKTVKKVEEAFKVMRDIAAEGGDILFVGTKKQAQXAIKEEATRAGMYFVNQRWLGGTLTNFQTIQKRIKRLKDIERMQEDGTFEVLPKKEVVQLKKELERLEKFLGGIKDMKGLPSALFVVDPRKERIAVAEARKLHIPIIGIVDTNCDPDEIDHVIPANDDAIRAVKLLTSKMADAILEAKQGEETVTA

SEQ ID NO: 27980 - protein, 322 aa, Leptolyngbya boryana
MAQDQKPTVVITGASSGVGLYAAKALVKRGWHVVMACRNLEKADSAAKSLGMSPDSYTLMHIDLGSLDSVRKFVTQFRESGKSLDALVCNAAVHMPLLKEPMRSPEGYELSVATNHFGHFLLCNLLLEDLKHSTHNDPRLIILGTVTANSKELGGKIPIPAPADLGDLSGLEAGFKAPIAMIDGKPFKAGKAYKDSKLCNMITSRELHRRYHDSTGIVFNTLYPGCVADTPLFRNSLPVFQKVFPWFQKNITGGYVSQELAGERTAQVVADPEFKQSGVHWSWGNRQKEGRESFVQELSEKVTDDAKAKRMWELSEKLVGLA

SEQ ID NO: 27981 - protein, 197 aa, Bradyrhizobium yuanmingense
PTPNLRGKTQIKFASFPTLEQLPLWGFDGSSTQQAEGHSSDCVLKPVAVFPDGARTNGVLVMCEVMMPDGKTPHASNKRATILDDAGAWFGFEQEYFFYKDGRPLGFPTSGYPAPQGPYYTGVGFSNVGDVARKIVEEHLDLCLAAGINHEGINAEVAKGQWEFQIFGKGSKTAADQMWMARYLMLRLTEKYGIDIE

SEQ ID NO: 27982 - protein, 458 aa, Marchantia paleacea
MPKRSNGSLVVRCAVSVVRFSKENVSCDLASENFTFSRDSFPVVSTVLRVSEAVYRMAAVASLGSALSVSSAALSQNVSVSNNATKESAFLGLRMGEVAKFGGALLSVSTVAANLKSKPGVLSVNAVTAPAETMNKPSSKKTATKSTCIITGASSGLGLATAKALADTGEWHVIMACRDFLKAERAARSVGIPKDSYTVIHCDLASFDSVRAFVDNFRRTERQLDVLVCNAAVYFPTDKEPKFSAEGFELSVGTNHMGHFLLARLLMEDLQKAKDSLKRMIIVGSITGNSNTVAGNVPPKANLGHLRGLAGGLNGVNSSSMIDGGEFDGAKAYKDSKVCNMFTMQEFHRRYHAETGITFSSLYPGCIAETGLFRNHVTLFRTLFPPFQKYITKGYVSEEEAGKRMAQVVSDPKLSKSGVYWSWNKDSGSFENELSEEASNPEKAKRLWELSERLSGLV

SEQ ID NO: 27983 - protein, 173 aa, Lemna gibba
MMVSTAAVARVRPAQTNMVGAFNGCRSSVAFPATRKANNDLSTLPSSGGRVSCMQVWPPEGLKKFETLSYLPPLSVEDLAKEVDYLLRNDWVPCIEFSKEGFVYRENNASPGYYDGRYWTMWKLPMFGCTDASQVIAEVEEAKKAYPEYFVRIIGFDNKRQVQCISFIAYKPT

SEQ ID NO: 27984 - protein, 112 aa, Xanthomonas axonopodis
MKMIMAIVKPFKLDDVREALAGCGVAGITVTEVKGFGRQKGHTELYRGAEYVVDFLPKVKIEVAVTDDQAERVVEAIVGAAGTGKIGDGKVFVYDLGTVVRIRTGELDSDAL

SEQ ID NO: 27985 - protein, 397 aa, Chlamydomonas reinhardtii
MALTMSAKSVSARAQVSSKAQAAPAVAVSGRTSSRVMPAPALAARSSVARTPLVVCAATATAPSPSLADKFKPNAIARVPATQQKQTAIITGASSGLGLNAAKALAATGEWHVVMACRDFLKAEQAAKKVGMPAGSYSILHLDLSSLESVRQFVQNFKASGRRLDALVCNAAVYLPTAKEPRFTADGFELSVGTNHLGHFLLTNLLLDDLKNAPNKQPRCIIVGSITGNTNTLAGNVPPKANLGDLSGLAAGVPAANPMMDGQEFNGAKAYKDSKVACMMTVRQMHQRFHDATGITFASLYPGCIAETGLFREHVPLFKTLFPPFQKYITKGYVSEEEAGRRLAAVISDPKLNKSGAYWSWSSTTGSFDNQVSEEVADDSKASKLWDISAKLVGLSA

SEQ ID NO: 27986 - protein, 273 aa, Unknown
  Candidatus Pelagibacter ubique HTCC1002
MKIPSLTIQQLLEAGVHLGHKTLRWNPKMKKYIFGKRDSIHIIDLTQTLELTNVALEKVYNTIANNGKILFVSTKKQASEAIAEVAKETGQYFVNYRWLGGMLTNWGTISGSIKKMKKYEADLVAENRGFTKKELLKMSVKKDKLERALGGIAEMKKVPDLVFIIDTNYESLAIAEASKLGIPICAILDSNSNPDGIDYPIPGNDDARRAIDLYCNLVKETIENAKKAAPSKSEEKPDVDDTKTKETSSKTIQEIDREKLDAKFSKKDKEKLN

SEQ ID NO: 27987 - protein, 148 aa, Brassica napus
  misc_feature (81)..(81): Xaa can be any naturally occurring amino acid
MIISKKNRREICKYIFHEGVLYAKKDYNLAKHPKLDVPNLEVIKLMQSFKSKEYVRETFSWQYYYWYLTNDGIEHLRSFLXLPSEVVPNTLKKSSKPPSRPFGSGPPGDRPRGPPRFGEDRPRFGDRDGYRGGPRGAMGDFGGEKVVL

SEQ ID NO: 27988 - protein, 388 aa, Triticum aestivum
MALQLLPSTLSVPKKGSSMGAAAVKDTAAFLGVSSKAKKASLAVRTQVATAPSSVTTSPGSATAKPSGKKTLRQGVVVITGASSGLGLAAAKALAETGKWHVVMACRDFLKASKAAKAAGMADGSYTVMHLDLASLDSVRQFVDAFRRAEMPLDVLVCNAAIYRPTARTPTFTADGHEMSVGVNHLGHFLLARLLMEDLQKSDYPSRRMVIVGSITGNSNTLAGNVPPKASLGDLRGLAGGLSGASGSAMIDGDESFDGAKAYKDSKVCNMLTMQEFHRRYHEETGITFSSLYPGCIATTGLFREHIPLFRTLFPPFQKFVTKGFVSEAESGKRLAQVVAEPSLTKSGVYWSWNKDSASFENQLSQEASDPEKARKVWELSEKLVGLA

SEQ ID NO: 27989 - protein, 310 aa, Unknown
  Halobacterium sp. NRC-1
MTFDSFADANEAEVTRAITRQWTDEFLDDTETDVIIVGGGPSGLMAAKELADRDVDVTIIEKNNYLGGGFWLGGFLMNKLTVRSPAEAVLDDLGVPYEYDEENDGLAVADAPHACSAMITAACDAGARIQNMTEFTDIVVRDDHAVAGAVVNWTPVHSLPRELTCVDPIALEADVVVDATGHDAVVVSKLHERGVLEADGIEHVEEHATGMDQSGDGEYGAPGHDSPGHDSMWVADSEDKVVEQTGKVHDGLVTAGLSTATVHGLTRMGPTFGAMLLSGKVAANAVMDELAVDEPRVDLPSTAAPAADDD

SEQ ID NO: 27990 - protein, 198 aa, Bradyrhizobium elkanii
PTPSLRGKTQIKEFASFPTLEQLPLWGFDGSSTQQAEGHSSDCVLKPVACYPDAARENGVLVMCEVMMPDGKTPHPSNKRATILDDDGAWFGFEQEYFFYKDGRPLGFPEEGYPAPQGPYYTGVGYKNVGSVARKIVEEHLNLCLAAGINHEGINAEVAKGQWEFQIFGKGSKTAADQMWMARYLMLRLTESYGIDIE

SEQ ID NO: 27991 - protein, 532 aa, Unknown
  Synechococcus sp. RS9917
MSFPDFSASDAQTQWQRFCDLLWFHDDLGMWLDVSRMHVNSADLDALAPQFDQAFQAMQALEGGAIANADEQRQVGHYWLRHPQLAPSPDVADHISAEIDQIEQFGKAVIAGEIKAPNGAAFTDVLWIGIGGSGLGPLLMIRALQNQGEGLPFHFFDNVDPNGMSRVLAGLGEAIKTTLVITVSKSGGTPEPHLGMEQARHRLEACGGDWPGQAVAITMKNSHLDQQAQQEGWLQRFDMFDWVGGRTSITSAVGLVPGALIGANIRDFLAGAAQMDEATRLADLRRNPSALMAASWFVAGEGKGKRDMVVLPYRDRLEVFSRYLQQLVMESLGKRLDRSGAEVHQGIAVYGNKGSTDQHAYVQQLRDGVDNFFVTFIEELTDVEDIPEINGERPGDFLDGFLQGTRSALTEGGRQSISISMRHLDARRLGALIALFERAVGFYGELVNINAYHQPGVEAGKKAAAAILKLQGQVEALLADGVSRSAADVQQAIGASPVEPIFWILRHLCANKRGYIAQGSWDQPASLRFSKA

SEQ ID NO: 27992 - protein, 160 aa, Bacillus subtilis
MSIYHMKVRTITGKDMTLQPFAGKVLMIVNTASKCGFTSQLKQLQELYDTYQQEGLEILGFPCNQFMNQEPGEEADIQEFCETNYGVTFPMFSKVDVNGKNAHPLFVYLTEHAKGMLGTKAIKWNFTKFIVDRNGEIVGRYSPNTNPKELEDDIVKLLEQ

SEQ ID NO: 27993 - protein, 384 aa, Mycobacterium avium
MVRTGYGVQVARTVSDSAPDSAEDPSEREFGQAGIALSTYRFPTGWFIVAFGSDLAPGQVKRAHYFGEELVLFRTASGRVHVMDAYCQHLGANLGVGGTVEGENIVCPWHGWQWRGDGSNALIPYSKIGCKNNVRIRTYPSMEWYGFVLAWHERHGRAPYWQPPVLPELETGEYYPLHPHTQMVNRVKVHPQMIIENAADPYHVQYVHKAANPATTASFEVAGYHLHATVNAHFGGGRAQTWLTPNGPVDAKIIYDNYSLGLGVVRFPSELVATVQVTGQTPVDEDYTDYFYTQASVREPGDTGDVPTGRAARFLALQKEVIKQDFFTWENMKYLEKPNLAPEEAHDYAALRRWAHRFYPGPQPAPTDFGYTADGEPDPAAAKA

SEQ ID NO: 27994 - protein, 296 aa, Unknown
  Rhizobium sp. CIAM2209
  misc_feature (236)..(236): Xaa can be any naturally occurring amino acid
RGKTQIKDYAEFPTLEQLPLWGFDGSSTQQAEGHSSDCVLKPVAVFPDPARTNGVLVMCEVMMPDGVTPHSSNKRATILDDEGAWFGFEQEYFFYKDGRPLGFPESGYPAPQGPYYTGVGYSNVGSVARQIVEEHLDQCLAAGINHEGINAEVAKGQWEFQIFGKGSKKAADQMWMARYLMQRLTEKYGIDIEYHCKPLGDTDWNGSGMHANFSTAYMREVGGKAYFEALMAAFDXNLMDHIAVYGPDNDKRLTGKHETAPWNKFSYGIADRGASIRVPHSFVNNGYKGYLEDRRP

SEQ ID NO: 27995 - protein, 373 aa, Acinetobacter baumannii
MSRLGVILIMTIKNRREALTQLQAEVDVVIIGGGQAALATAYFLKRKKIPFVILDDQAQAGGAWSHAWESLRLFSPNTWSSLSGWMMPTTEQTYPTRNEVIDYLSAYEQRYQFLIIRPVHVDHIEQKDDYLDVYVGDQYWRAKAVVSATGTWSQPYIPHYKGHERFEGLQTHSAHYLNPEPFINKKVIIVGGGNSGAQILAEVSKVADTTWVTVTPPQFLSDDVDGRILFLRATERLKAQQKGRVIDQPVGGLGDIVMIDSVKEARERGVLHSREPFTSFEEHSVIWADGTRQAVDAVIWCTGFKASLDHLRSMNVVEPDQTVAVNDGRSIKVNSLWLVGYGEWTGMASATLIGVSRTARATVDQIAAYLVNL

SEQ ID NO: 27996 - protein, 275 aa, Picrophilus torridus
MRLIENWFSERYSDNLQLSFRVQDQLLSVKTDYQRIDLFNTYDFGKLLSIDGTVQLTEKDEYIYHEMITMVPYYCTAKSDSALIIGGGDGGAAKRLIDLGIKRIVNVEIDQNVVEISRKYFPELADSFNNKNVELIIGDGIKYVKDTDESFDLIIIDSTDPVGPAEGLFNKSFYENARARLSDDGIIVTQSGSPYYQPEALKMATKGMLDVFSNVRTYIAFIPTYPSGLWSFTMASKSEIMQRKDNIIPGRYFNEDVLKGSFYLPEFVKNIIKSI

SEQ ID NO: 27997 - protein, 317 aa, Acinetobacter baumannii
MQKRHSKLVILGSGPAGYSAAVYAARANLKPTLIAGLQLGGQLTTTTEVDNWPGDPEGLTGPVLMERMQAHAERFGTEIVYDHINEVDLSVRPFLLKGDMEEFTCDALIIATGATAQYLGLESEAKFMGQGVSACATCDGFFYKNQKVMVVGGGNTAVEEALYLSNIAEHVTLVHRRDSLRSEKILQDHLFAKEKEGKISILWNNQVDEVLGDNTGVTSVRLKSTSDGSTQDVEVQGLFVAIGHKPNTGMFDGQLNLRDGYIQVQSGTSGNATATSVAGVFAAGDVADSIYRQAITSAGSGCMAALDAEKYLDQLSN

SEQ ID NO: 27998 - protein, 294 aa, Unknown
  Rhizobium sp. USDA 4003
RGKTQIKEFAEFPDLEQLPLWGFDGSSTQQAEGHSSDCVLKPVAVYPDPARTNGVLVMCEVMMPDGVTPHASNKRATILDDEGAWFGFEQEYFFYKDGRPLGFPESGYPAPQGPYYTGVGYSNVGSVARQIVEEHLDLCLAAGINHEGINAEVAKGQWEFQIFGKGSKKAADQMWMARYLMQRLTEKYGIDIEYHCKPLGDTDWNGSGMHANFSTAYMREVGGKAYFEALMAAFDKNLMDHIAVYGPDNDKRLTGKHETAPWNRFSYGIADRGASIRVPHSFIKSDYKGYLEDR

SEQ ID NO: 27999 - protein, 294 aa, Unknown
  Rhizobium sp. USDA 2061
RGKTQIKEFDAFPTLEQLPLWGFDGSSTQQAEGRSSDCVLKPVAVYPDPVRTNGALVMCEVMMPDGKTPHPSNTRATVLDDESAWFGFEQEYFFYKNGRPLGFPEQGYPAPQGPYYTGVGYKNVGDIARRIVEEHLDICLAAGINHEGINAEVAKGQWEFQVFGKGSKKAADEVWLARYLLLRLTEKYGIDVEFHCKPLGDTDWNGSGMHANFSTAYMREVGGKDYFEALMAAFEKNLHDHINVYGPDNHLRLTGKHETAPWDKFSYGVADRGASIRVPHSFVNNGYRGYVEDR

SEQ ID NO: 28000 - protein, 296 aa, Unknown
  Rhizobium sp. 2M164
RGKTQIKEFDEFPTLEQLPLWGFDGSSTQQAEGRSSDCVLKPVAIYPDPARTNGALVMCEVMMPDGVTPHASNARATILDDEHAWFGFEQEYFFYQNGRPLGFPEQGYPAPQGPYYTGVGYSNVGDVAREIVEEHLDLCLAAGINHEGINAEVAKGQWEFQIFGKGSKKAADQIWMARYLLQRLTEKYGIDIEYHCKPLGDTDWNGSGMHCNFSTKFLREVGGKEYFEALMAQFDKNLMDHIAVYGPDNDKRLTGKHETAPWNKFSYGVADRGASIRVPHSFIKKDYKGYLEDRRP

SEQ ID NO: 28001 - protein, 513 aa, Brassica oleracea
MGAFETENTAKDAAALETQSSLEEFNQPSPLRKIISVSSIAAGVQFGWALQLSLLTPYVQLLGIPHKWSSLIWLCGPVSGMIVQPIVGFHSDRCTSRFGRRRPFIAAGAAMVAVAVFLIGYAADIGYKMGDKLEQTPRVRAIGIFALGFWILDVANNTLQGPCRAFLADLAAGDAKRTRVANAFFSFFMAVGNVLGYAAGSFTNLHKMFPFAMTNACDLYCANLKSCFFLSITLLLIVTVTSLWYVKDKQWSPPPVAADEEKKSVPFFGEIFGAFKVMERPMWMLLIVTALNWIAWFPFLLFDTDWMGREVYGGDSEGDARLKQIYNKGVQSGALGLMFNSIVLGFMSLGVEWIGKKVGGAKRLWGIVNFILAIGLAMTVLVTKLAADYRKVAGPYAGPSPGIRAGALSLFAVLGIPLAITFSIPFALASIFSSSSGAGQGLSLGVLNLAIVIPQMIVSLGGGPFDALFGGGNLPAFIVGAIAAAISGVLAITVLPSPPPDAPALKTGAMGFH

SEQ ID NO: 28002 - protein, 296 aa, Unknown
  Rhizobium sp. USDA 3620
  misc_feature (82)..(82): Xaa can be any naturally occurring amino acid
  misc_feature (291)..(291): Xaa can be any naturally occurring amino acid
  misc_feature (294)..(294): Xaa can be any naturally occurring amino acid
RGKTQIKEYAEFPTLDQLPLWGFDGSSTMQAEGHSSDCVLKPVAIYPDPARTNGVLVMCEVMMPDGVTPHASNKRATILDDXGAWFGFEQEYFFYKDGRPLGFPESGYPAPQGPYYTGVGYSNVGSVARQIVEEHLDLCLAAGINHEGINAEVAKGQWEFQIFGKGSKKAADQMWMARYLLQRLTEKYGIDIEYHCKPLGDTDWNGSGMHANFSTAHMREVGGKAYFEALMAAFDKNLMDHIAVYGPDNDKRLTGKHETAPWNKFSYGIADRGASIRVPHSFIKNDYKGYXEDXRP

SEQ ID NO: 28003 - protein, 162 aa, Oryza sativa
MALVEGNNGVSGGAVSFSEEQEALVLKSWAIMKKDSANIGLRFFLKIFEVAPSASQMFSFLRNSDVPLEKNPKLKTHAMSVFVMLRKAGKVTVRDTTLKRLGATHFKYGVGDAHFEVTRFALLETIKEAVPVDMWSPAMKSAWSEAYNQLVAAIKQEMKPAE

SEQ ID NO: 28004 - protein, 181 aa, Nicotiana sylvestris
MAFLIMSSAAAVATGTNAAQASMIAPFTGLKSATSFPVSRKQNLDITSIASNGGRVQCMQVWPPINKKKYETLSYLPDLSEEQLLREVEYLLKNGWVPCLEFETEHGFVYRENNKSPGYYDGRYWTMWKLPMFGCTDATQVLAEVEEAKKAYPQAWIRIIGFDNVRQVQCISFIAYKPEGY

SEQ ID NO: 28005 - protein, 710 aa, Bacillus licheniformis
MPGISRPFEAYLDEMRTITVLVPKSRASSCSPPFLLEDDQGERIELSVKAQVELEEQFKYVLESSCTVPFGRVHKVCCEESVWTDLQIGSVTRSAAFDKAFFYDGRLGAFYSKGSTLFKVWAPTASAAAIKLEDPDSLQTNTFQMMRRKKGVFEVTVEGDLNGWSYLYELYVNGKPLLTVDPYAKAVTANGEKGVVLDPEEVKVEKHRAPRLHSPCDAVIYEVHIRDFSIHEDSGMRHKGKYVAFTEDGTETSGGFSTGIAYLKELGVTHIEVLPFHDFAGVDELSPDQSYNWGYNPLHFNAPEGSYSLDPQNPKCRITELKTMIQSLHKHGFSVIMDAVYNHVYKRETSPFEKTVPGYFFRHNEYGFPSDGTGVGNDIASERLMVRKYILDSVRYWLEEYDVDGIRFDLMGILDIETVRQISTLAENVKPGVPLFGEGWDLNTPLDSGQKATLQNAGKVPAVGFFNDRFRNAVKGSTFELSDRGYALGDTGKKAALQHGIAGSPGFLQPAQSINYVECHDNHTFWDKMALCFEEDADTKRLRQRLAVSIVLLSQGVPFLHAGQEFCRTKNGDSNSYRSGDDINKLDWEKRAELCEDVEYVRQLIRLRRSHPAFRLQKEEEVKEHLSFMDGTGEVTAYKLKNIAAIDPWNEIIVVHCPFAKKETLKLPDQKQYLLHCDPFTFFNGKVQAEKRLRLNGIGTYVLYEPKGIF

SEQ ID NO: 28006 - protein, 458 aa, Escherichia coli
MKNASTVSEDTASNQEPTLHRGLHNRHIQLIALGGAIGTGLFLGIGPAIQMAGPAVLLGYGVAGIIAFLIMRQLGEMVVEEPVSGSFAHFAYKYWGPFAGFLSGWNYWVMFVLVGMAELTAAGIYMQYWFPDVPTWIWAAAFFIIINAVNLVNVRLYGETEFWFALIKVLAIIGMIGFGLWLLFSGHGGEKASIDNLWRYGGFFATGWNGLILSLAVIMFSFGGLELIGITAAEARDPEKSIPKAVNQVVYRILLFYIGSLVVLLALYPWVEVKSNSSPFVMIFHNLDSNVVASALNFVILVASLSVYNSGVYSNSRMLFGLSVQGNAPKFLTRVSRRGVPINSLMLSGAITSLVVLINYLLPQKAFGLLMALVVATLLLNWIMICLAHLRFRAAMRRQGRETQFKALLYPFGNYLCIAFLGMILLLMCTMDDMRLSAILLPVWIVFLFMAFKTLRRK

SEQ ID NO: 28007 - protein, 180 aa, Unknown
  Petunia x hybrida
MASSVISSAAVATRTNVAQASMVAPFNGLKSAVSFPVSSKQNLDITSIASNGGRVQCMQVWPPYGKKKYETLSYLPDLTDEQLLKEIEYLLNKGWVPCLEFETEHGFVYREYHASPRYYDGRYWTMWKLPMFGCTDATQVLGELQEAKKAYPNAWIRIIGFDNVRQVQCISFIAYKPPGF

SEQ ID NO: 28008 - protein, 486 aa, Oryza sativa
MEAKPVAMEVEGVEAAGGKPRFRMPVDSDLKATEFWLFSFARPHMASFHMAWFSFFCCFVSTFAVFARLAMGTACDLVGPRLASASLILLTTPAVYCSSIIQSPSGYLLVRFFTGISLASFVSAQFWMSSMFSAPKVGLANGVAGGWGNLGGGAVQLLMPLVYEAIHKIGSTPFTAWRIAFFIPGLMQTFSAIAVLAFGQDMPGGNYGKLHKTGDMHKDSFGNVLRHALTNYRGWILALTYGYSFGVELTIDNVVHQYFYDRFDVNLQTAGLIAASFGMANIISRPGGGLLSDWLSSRYGMRGRLWGLWTVQTIGGVLCVVLGIVDFSFAASVAVMVLFSFFVQAACGLTFGIVPFVSRRSLGLISGMTGGGGNVGAVLTQYIFFHGTKYKTETGIKYMGLMIIACTLPVMLIYFPQWGGMLVGPRKGATAEEYYSREWSDHEREKGFNAASVRFAENSVREGGRSSANGGQPRHTVPVDASPAGV

SEQ ID NO: 28009 - protein, 163 aa, Prototheca wickerhamii
MLAMQGPVTGRLPCASQLTRPKQRHGKYIAFCTRNEVSRSSRPRASSVSRAASAQQSRSGGGARPWRPISCHSPARLVGSVDDANFVRGASPAIDREELSRTVRAVILAGGEVKNPLTRSRAMPAVPLGSSLMMIDIPISNCMSAGINKIYVLTQFQSHTLNS

SEQ ID NO: 28010 - protein, 92 aa, Vigna radiata
MGFRLPGIRKTLSARNEASSKVLDAPKGYLAVYVGENMKRFVIPVSHLNQPLFQDLLSQAEEEFGYDHPMGGLTIPCSEDLFQHITSCLSAQ

SEQ ID NO: 28011 - protein, 181 aa, Solanum tuberosum
MASSVISSAAVATRTNVTQAGSMIAPFTGLKSAATFPVSRKQNLDITSIASNGGRVRCMQVWPPINMKKYETLSYLPDLTDEQLLKEVEYLLKNGWVPCLEFETEHGFVYRENHKSPGYYDGRYWTMWKLPMFGCTDATQVLAEVQECKKSYPQAWIRIIGFDNVRQVQCISFIAYKPEGY

SEQ ID NO: 28012 - protein, 197 aa, Brassica napus
NTSQTWLIHLLRRTCLRRSQTTFPLRPRHRWLRSERLHFRPHQGVGGVVTNWALVSMNHDTQSCMDPNVMEAKIVVSSCGHDGPFGATGVKRLKSIGLIDHVPGMKALDMNTAEDAIVRLTREVVPGMIVTGMEVAEIDGAPRMGPTFGAMMISGQEAAHLALKALGQPNVIDGSYVGDLSPELVLAAADSAETVNA

SEQ ID NO: 28013 - protein, 337 aa, Heliobacillus mobilis
MNEAKENKEVTNRNDGGNGQTALATFAGGCFWCMVGPFEELDGIHQILSGYTGGHKENPTYHEVCSDETGHFEAIQITYDPAAVAYETLLDRFWRQIDPTDPGGQFHDRGSSYRTAIFYHDEGQREKAEASKKELEESRRFDKPIVTQILPASTFYPAEAYHQDYHKKSPFRYGLYRMGSGRDAFLEQYWRKPEKAQLKQKLSPVQYEVTQNNGTEPPFRNEYWDNHREGIYVDIVSGEPLFSSIDKFDSGCGWPSFSRPLHEEKVKEKMDLSHGMTRTEVRSQGADSHLGHVFDDGPAPGGLRYCINSAALRFIPKEDLEKEGYGQYKSLFEKKNS

SEQ ID NO: 28014 - protein, 121 aa, Staphylococcus epidermidis
MSKTPYELIGQKALYQMIDHFYQLVEKDSRINHLFPGDFKETSRKQKQFLTQFLGGPDLYTQEHGHPMLKRRHMEFTISEYERDAWLENMHTAIQHAKLPAGVGDYLFERLRLTANHMVNS

SEQ ID NO: 28015 - protein, 198 aa, Bradyrhizobium elkanii
PTPSLRGKTQIKEFASFPTLEQLPLWGFDGSSTQQAEGHSSDCVLKPVACYPDAARENGVLVMCEVMMPDGKTPHVSNKRATVLDDEGAWFGFEQEYFFYKDGRPLGFPEEGYPAPQGPYYTGVGYKNVGSVARKIVEEHLNLCLAAGINHEGINAEVAKGQWEFQIFGKGSKTAADQMWMARYLMLRLTESYGIDIE

SEQ ID NO: 28016 - protein, 258 aa, Xanthomonas campestris
MTTHRWRLDGQTALITGASAGIGLAIARELLGFGADLLMVARDADALAQARDELADEFPERELHGLAADVSDDEERRAILDWVEDHADGLHLLINNAGGNVTRAAIDYTEDEWRGIFETNVFSAFELSRYAHPLLTQHAASAIVNVGSVSGITHVRSGAPYGMTKAALQQMTRNLAVEWAEDGIRVNAVAPWYIRTRRTSGPLSDPDYYEQVIERTPMRRIGEPEEVAAAVGFLCLPAASYITGECIAVDGGFLRYGF

SEQ ID NO: 28017 - protein, 178 aa, Glycine max
  misc_feature (115)..(115): Xaa can be any naturally occurring amino acid
MASSMISSPAVTTVNRAGAGMVAPFTGLKSMAGFPTRKTNNDITSIASNGGRVQCMQVWPPIGKKKFETLSYLPDLDDAQLAKEVEYLLRKGWIPCLEFELEHGFVYREHNRSPXYYDGRYWTMWKLPMFGCTDASQVLKELQEAKTAYPNGFIRIIGFDNVRQVQCISFIAYKPPGF

SEQ ID NO: 28018 - protein, 216 aa, Zea mays
MTTARLVSTSPARLPSTSASPIPRTSLCVVGRAPAFSARALGFSLRLKPSPAMAAAGPPTAHGDSIGSSRIGEVKRVTKETNVHVKINLDGTGVAECSTGIPFLDHMLDQLASHGLFDVYVKAIGDTHIDDHHSNEDIALAIGTALLEALGDRKGINRFGHFTAPLDEAAVEVILDLSGRPHLSCGLDIPTQRVGTYDTQVNCEICKPFVICINIC

SEQ ID NO: 28019 - protein, 96 aa, Brassica napus
EYYSYNPILGDHRVNFWGYSTIGFFSPMVRYSSASSRNFAGRAINEFKTLVKEAHKRGIEVIMDVVLNHTAEGNEKGPILSFRGVDNSVYYMLAPK

SEQ ID NO: 28020 - protein, 198 aa, Bradyrhizobium japonicum
PTPNLRGKTQIKEFASFPTLEQLPLWGFDGSSTQQAEGHSSDCVLKPVAVFPDAARTNGVLVMCEVMMPDGKTPHASNKRATILDDAGAWFGFEQEYFFYKDGRPLGFPSSGYPAPQGPYYTGVVFSNVGDVARKIVEEHLDLCLAAGINHEGINAEVAKGQWEFQIFGKGSKKAADEMWMARYLMLRLTEKYGIDID

SEQ ID NO: 28021 - protein, 748 aa, Rickettsia rickettsii
MFNEITKSVTWNGQVLELSTGKIARQADGAVTVKMGNSVLLCTAVVANKAKEGIGFLPLTINYREMAYAAGKIPGGFFKHEGKPSDREVLVSRLIDRPIRPLFHPAFVNETHVTCSVLSYDPETPVDILAIIGASAALSLSPAPYLEIVAASKVGLINGEFVLNPTLALLKTSQLDLVVAGTSDSVMMVESEAHLLSEEQMLEAVKFGFESFQPVIKIIKELAEEAKKPKLEMQALYPASLKKEIEKLFVKEIEQAFAMKSKQERSTNLDLITEKVFTHFVSDIENKKYSHYQIESALKAIESGILRNEILEKNRRIDGRSTTDIRQIACEIGLLPSAHGSALFTRGETQSLVSTTFGTSLDEQIVDSLEGEYKERFMLNYIFPPYSVNEAMPMKAPSRREVGHGKLAWRAINPILPNKVQFPYSIRVVAETTESNGSSSMATVCGSSLALMYAGVPIKAPVAGIAMGLVKEGKNFAVLSDILGDEDYFGDMDFKVAGTGEGITALQMDIKISGVDFKIMKVALEQARLGRLHILEQMNKVISKPNNELSKNAPSTTTIKIDKDKIRDIIGPGGKVIKEICETSGAKIDISDDGTVSVYASDRDKLKVALDKIKAIVVEPEIGEIFNGTVVKVLDSGAFINYVGNKDGFVHISEVSGERIETVSSVLKQGDIVKVKLIGFDNKGKAKLTIKNADKDKFSNNTKPKTSVNNTKDNSEPEQRHDSSKKRAWNEDNNAEIAEVITERKYFN

SEQ ID NO: 28022 - protein, 489 aa, Clostridium perfringens
MSQEQNTNLKRGLKSRHLSMIAMGGAIGTGIFLAMGDTLHQAGVGGAFVAYGIIGVMVYFLCTSLGEMATYMPETGSFGAYATKFVDPALGFALGWNYWYNWAITIAAEMVAGSLLMKFWFPNIPAIVWSALFLVIILTLNLLSAKAYGESEFWFAAVKVATVIIFLIVGVLMIFGILGGDNVGFKNFYENGGPFIGGAKSIFMIFLIAGFSFQGTELVGVAAGESEDPEKNVPKAVNTIFWRILLFYLGTILVIGALVPNAQAGVETSAFTIVFEKLGLAGAASIMNAIILTSVLSAGNSGMYASSRMLYAMAKNGMAPKIFEKTNSRGVPVNAIIITTIIASLCFLTGIYAENTVYVWLVAASGLSGFIAWLGIAICHYRFRKAYVAQGKDMSRLVYKAKLFPLGPIIALILCGIIVLGQGYAYLDVRNGVDWGGLISSYIGLPLFFGLFAYYKIKYKTKIIDLKDVDLSVEHIDTDESIEDEVFSY

SEQ ID NO: 28023 - protein, 198 aa, Bradyrhizobium japonicum
PTPNLRGKTQIKEFASFPTLEQLPLWGFDGSSTQQAEGHSSDCVLKPVAVFPDAARTKGVLVMCEVMMPDGKTPHASNKRATILDDAGAWFGFEQEYFFYKDGRPLGFPASGYPAPQGPYYTGVGFSNVGDVARKIVEEHLDLCLAAGINHEGINAEVAKGQWEFQIFGKGSKKAADEMWMARYLMLRLTEKYGIDIE

SEQ ID NO: 28024 - protein, 223 aa, Nicotiana tabacum
MAEVKLLGFWYSPFSRRVEWALKIKGVKYEYIEEDRDNKSSLLLQSNPIHKKVPVLIHNGKRIVESMVILEYIDETFEGPSILPKDPYDRALARFWAKFLDDKVPAVVKTFLRKGEEQEKDKEEVCEMLKVLDNELKDKKFFVGDKFGFADIAANLVAFWLGVFEEASGVVLVTSEKFPNFCKWRGEYINCSQIKESLPPRDELLAFYRSRCQAAAASASAPK

SEQ ID NO: 28025 - protein, 198 aa, Bradyrhizobium japonicum
PTPNLRGKTQIKEFASFPTLEQLPLWGFDGSSTQQAEGHSSDCVLKPVAVFPDAARTNGVLVMCEVMMPDGKTPHASNKRATILDDAGAWFGFEQEYFFYKDGRPLGFPSSGYPAPQGPYYTGVGFSNVGDVARKIVEEHLDLCLAAGINHEGINAEVAKGQWEFQIFGKGSKKAADEMWMARYLMLRLTEKYGIDIE

SEQ ID NO: 28026 - protein, 311 aa, Arabidopsis thaliana
MDQLRDDPTAHAQSLPASQHNLEDTDETCEDSRYHSDQGSGAQAINYNGHNKLMENGKSVDERDEFKETFDVTMDLIGGIDKRPDSIYKDKSRDECVGPELGLSLKRSCSVSFENQDESKHQKLSLSDASAFSRFEESKSAEKAVVALEESTSGEPKTPTESHEKLRKVTSDQGSATTSSNQENIGSSSVSFRNQVLQSTVTNQKQDSPIPVESNREKAASKEVEAGSQSTNEGIAGQSSSTEKPKEEESAKQRWSRSQREAALMKFRLKRKDRCFDKKVRYQSRKKLAEQRPRVKGQFVRTVNSDASTKS

SEQ ID NO: 28027 - protein, 378 aa, Clostridium perfringens
MSENLTMSELMDSFELKHFHKGEIVKGKVISVKNDEIIVNIGHFADGVVPRNEISNDKNFDINSINVDDDIFVMVLSGDDGEGNVLLSKKRADAIKVWDDLKEAFEKEKSIKVSLKEVVKGGIVGDFNGLRVFMPASQCAGRRIENLEELVGKTLEVRVIEFNKENRKVVVSRRIIDEEIRNNEKKALWSSIKEGEKRKGKVTRLAKFGAFVDIGGVEGLVHLSDMSWSRVHKPEEVVSVGDEVEVFVSEVDMDRERIALSLKDVIKNPWETLEGLKVGDVVSGKVTNFIKVGAFVEVLPGIEGLVHISEITDENIAKPSDILELGQEVKVKILNIDDENKKMSLSIKDAVETSNEYIQYNDEEEGYSLADLFKGLNL

SEQ ID NO: 28028 - protein, 349 aa, Legionella pneumophila
MFSRMLFCHRYFNVFIFVIIFAILTQKIRKAETMSISNHHRLIILGSGPAGYTAAVYAARANLNPVLITGMQPGGQLTTTTDVDNWPGDIEGLQGPALMERMQKHAERFDTQVIFDHIVKADLAQAPFTLQGDSTTYTCDALIIATGASARYLGLPSETAYQGRGVSACATCDGFFYRNKSVCVIGGGNTAVEEALYLSNLASSVTLIHRRDSLRAEKILQDKLFEKAHSGNIKIIWNSTLDEVLGDGKKVTGAMIRNLKTGETDQLAMDGIFIAIGHTPNTAIFQDQLAMRDGYILIKSGLDGMATSTSVPGVFACGDVADHVYRQAITSAGFGCMAALDAEKYLDSI

SEQ ID NO: 28029 - protein, 500 aa, Staphylococcus epidermidis
MKKNNKQNDGVQRGLKDRHISMIAIGGCIGTGLFMTSGGAIHDAGALGALIAYAVIGAMVFFLMTSLGEMATYLPVSGSFSTYATRFVDPSLGFALGWNYWFNWVITVAADVTIAAQVIQYWSPMQGIPAWVWSCIFLIIIFALNSLSVRVYGESEYWFALIKVVTVIIFIGIGILTILGIMGGEFVGFDTFTKGDGPILGGNLGGSLLSILGVFLVAGFSFQGTELIGITAGESENPERAVPKAIKQVFWRILLFYILAIFIIGMLIPYDSKALMGGGDSIATSPFTLVFKNAGLAFAASFMNAVILTSVLSAGNSGMYASTRMLYSMSKDKLAYNSFGKTNKSGVPYVSLIATGVLVILIFALQHLSGDAYEYIVAASGMTGFIAWVGIAISHFRFRRAFDKQNYDKSKLKYKAKLFPFGPIFAGILCVIVIIGQDVDFIKTGNFDMNRFFITYMGIPVFLIFFFYHKFRYKTKKIPLNKVDLRQDVSMEEVRHHKNN

SEQ ID NO: 28030 - protein, 198 aa, Unknown
  Bradyrhizobium sp. IRBG127
PVPNLRGKTQIKEFSSFPTLEQLPLWGFDGSSTMQAEGHSSDCVLKPVAVYPDAARTNGVLVMCEVMMPDGKTPHPSNARATILDDPDAWFGFEQEYFFYKDGRPLGFPEYGYPAPQGPYYTGVGFKNVGDVARKIVEEHLDLCLAAGINHEGINAEVAKGQWEFQVFGKGSRTAADQMWMARYLMLRLTEKYGIDIE

SEQ ID NO: 28031 - protein, 155 aa, Arabidopsis thaliana
  misc_feature (77)..(77): Xaa can be any naturally occurring amino acid
MESEGKIVFTEEQEALVVKSWSVMKKNSAELGLKLFIKIFEIAPTTKKMFSFLRDSPIPAEQNPKLKPHAMSVFVMXQLRKTGKVTVRETTLKRLGASHSKYGVVDEHFEVAKYALLETIKEAVPEMWSPEMKVAWGQAYDHLVAAIKAEMNLSN

SEQ ID NO: 28032 - protein, 193 aa, Lactococcus garvieae
MKRIAVLTSGGDAPGMNAAIRAVVRKAISEGIEVYGINHGYAGMVAGDIFPLTSASVGDKVGRGGTFLYSARFPEFAQLEGQLAGIEQLKKHGIEGVVVIGGDGSYHGAMRLTEHGFPAVGLPGTIDNDIVGTDFTIGFDTAVSTVVDAIDKIRDTSSSHHRTFVVEVMGRNAGDIALWSGIAAGADDIAIPE

SEQ ID NO: 28033 - protein, 513 aa, Cryptococcus neoformans
MRSTQRRLSSLPPTIRSLLSSRRSTLPSVSSTTHLETVSCANEPVEVNGWIKSVRAHKNVAFVEVSDGSTGENIQAVLKGKSKAEGLSIGASAKLKGRLEQSRGRGQDVELVVEDAQVLGTCDAEAYPIQKKSLPASVLRDNAHLRFRTSQTAAVMRIRDALARDWHDWFESHDFVHVHTPILTGSDCEGAGEVFTIVDHPPPSSSSSPQPFFPHPVHLTVSAQLHLEAPTHALSRTYTLSPSFRAEPSLTSRHLSEFHMLEAEVAWENDLDGLLSVVEEGVKSTVGNILNGEKRGKRLRDDLSIVAKSLRDVDDLGSVIDPAQEFADPLYHLQLVMDKPFTRITYTSALELLSSLHADSPSTISPPPLWGQGISTDHEKLLAAHFNGPVFVTRYPKELKPFYMLPTPSTIENEKTHASQGSTVECFDLLFPHWGEMAGGSLREHRLTELTHAIEEMGMKKEEYNWYLDLRKYGSVPHGGWGMGWDRWVGWVTGLGNVRDVVPYARWKGHCKY

SEQ ID NO: 28034 - protein, 73 aa, Legionella pneumophila
MAKEDHIEMAGTVIDTLPNTMFRVELENGHIVTAHISGRMRKNYIRILTGDKVKVELTPYDLSKGRIIFRDKG

SEQ ID NO: 28035 - protein, 133 aa, Triticum aestivum
  misc_feature (2)..(2): Xaa can be any naturally occurring amino acid
  misc_feature (4)..(4): Xaa can be any naturally occurring amino acid
  misc_feature (8)..(8): Xaa can be any naturally occurring amino acid
  misc_feature (11)..(11): Xaa can be any naturally occurring amino acid
  misc_feature (14)..(14): Xaa can be any naturally occurring amino acid
  misc_feature (16)..(16): Xaa can be any naturally occurring amino acid
  misc_feature (20)..(20): Xaa can be any naturally occurring amino acid
  misc_feature (26)..(28): Xaa can be any naturally occurring amino acid
  misc_feature (31)..(31): Xaa can be any naturally occurring amino acid
  misc_feature (36)..(37): Xaa can be any naturally occurring amino acid
  misc_feature (39)..(39): Xaa can be any naturally occurring amino acid
  misc_feature (46)..(48): Xaa can be any naturally occurring amino acid
  misc_feature (55)..(55): Xaa can be any naturally occurring amino acid
  misc_feature (58)..(60): Xaa can be any naturally occurring amino acid
  misc_feature (64)..(64): Xaa can be any naturally occurring amino acid
  misc_feature (70)..(70): Xaa can be any naturally occurring amino acid
  misc_feature (83)..(83): Xaa can be any naturally occurring amino acid
  misc_feature (91)..(91): Xaa can be any naturally occurring amino acid
  misc_feature (109)..(109): Xaa can be any naturally occurring amino acid
  misc_feature (118)..(118): Xaa can be any naturally occurring amino acid
  misc_feature (126)..(127): Xaa can be any naturally occurring amino acid
  misc_feature (129)..(130): Xaa can be any naturally occurring amino acid
MXRXPARXYRXQMXNXPYPXSRYCRXXXDPXIRIYXXGXMKKKGAXXXSHCVHLXSWXXXNGSXEALEAXRIACNKDMTKHAXKDAFHLRXRVHPFHVLRINKMLSCAXADRLQTGMXFAFEKTQXXCXXVAI

SEQ ID NO: 28036 - protein, 286 aa, Synechococcus elongatus
MSADAPVWIDEVFEDRVRYGLRGQILWEETSPFQKITIVDTEHYGRGLLLDDCWMTAERCEVCYHEYLVHPPLTTAASIARVLVIGGGDGGTVREVLRYAEVEQVDLVEIDGRVVELSQEYLGAIGTAWADPRLNVKIGDGIAFVQTAPDASYDVILVDGSDPAGPAAGLFNREFYENCRRVLKPGGVFASQAESPDSFLAVHLEMIETLSAVFAEAKPYYGWVPMYPSGWWSWLYASDTPGQFQKPQSDRLAAIEPQVEIYNRDIHQAAFAQPNFVRRGLSARQG

SEQ ID NO: 28037 - protein, 188 aa, Arabidopsis thaliana
MIRVTGTAAPAMSVVFPTSWRQPVMLPLRSAKTFKPHTFLDLKGGKEMSEFHEVELKVRDYELDQFGVVNNAVYANYCQHGMHEFLESIGINCDEVARSGEALAISELTMNFLAPLRSGDKFVVKVNISRTSAARIYFDHSILKLPNQEVILEAKATVVWLDNKHRPVRIPSSIRSKFVHFLRQNDTV

SEQ ID NO: 28038 - protein, 508 aa, Brassica oleracea
MEKGSNGSAALEMQTSELDQPAALRKIISVSSIAAGVQFGWALQLSLLTPYVQLLGIPHKWASLIWLCGPISGMLVQPIVGYHSDRCTSRFGRRRPFIVAGAGLVTVAVFLIGYAADIGHSMGDQLDKPPRTRAIAIFALGFWILDVANNTLQGPCRAFLADLSAGNAKKTRTANAFFSFFMAVGNVLGYAAGSYKNLYKVVPFTMTKSCDLYCANLKTCFFLSITLLLLVTFMSLCYVTEKPWTPEPTADGKPSSVPFFGEIFGAFKELKRPMWMLLIVTALNWIAWFPFLLFDTDWMGREVYGGNSDATASVASKKLYNDGVRAGALGLMLNAIVLGFMSLGVEWVGRKMGGAKRLWGAVNFILAICLAMTVVVTKQAENHRRDHGGAKTGPPGNVTAGALTLFAVLGIPQAITFSIPFALASIFSTNSGAGQGLSLGVLNLAIVVPQMVVSVGGGPFDELFHGGNIPAFVLGAIAAAVSGILALTVLPSPPPDAPAFKTGAMGFH

SEQ ID NO: 28039 - protein, 411 aa, Zea mays
MNALAATSRNFKQAAKLLGLDSKLEKSLLIPFREIKVECTIPKDDGTLASYVGFRVQHDNARGPMKGGIRYHHEVDPDEVNALAQLMTWKTAVANIPYGGAKGGIGCSPGDLSISELERLTRVFTQKIHDLIGIHTDVPAPDMGTNSQTMAWILDEYSKFHGYSPAVVTGKPVDLGGSLGRDAATGRGVLFATEALLAEHGKGIAGQRFVIQGFGNVGSWAAQLISEAGGKVIAISDVTGAVKNVDGLDIAQLVKHSAENKGIKGFKGGDAIAPDSLLTEECDVLIPAALGGVINKDNANDIKAKYIIEAANHPTDPEADEILSKKGVLILPDILANSGGVTVSYFEWVQNIQGFMWDEEKVNAELRTYMTRAFGDVKQMCRSHSCDLRMGAFTLGVNRVARATVLRGWEA

SEQ ID NO: 28040 - protein, 600 aa, Cryptococcus neoformans
MSEQKSSVVEQAQDVASKLANAVTDTLKLSEDQKSDLPVVYIDEKAGSDTEGTGAELSPFASPLAAYQSFKPSPESDANPSSVATFMVRKVDSVERNDWIELSASAKKKLVKSIGGWRKAEAKLAAEGERLEKQKKEQAEKDRLRREEAKNVVLVDDPSKESKSAKIWAVPELVGKRVRLQGWVHRFRPQKTNFFVVLRDGSGFLQCILTGDCIRTVDALDLSLECTIEVVGIVEKVKEGQTAPGGVELAVDYWKIIGRAPTGAEALESRLQPDTEASIRADLRHLELRGEIASSVMRFRALLLRAFRESFNKRRITEVTPPCMVQTSVEGGSTLFEFDYYGSKAYLTQSSQLYLETVLPSLGDVYCIQESFRAEKSLTRRHLSEYTHLEAELVFIKFKDLLDHLEDMICEVIDVLLADPVASEIIKTLNPEFVPPQRPFVRLDYRDAITYLNEHGIKREDGEDHVVGDDIAEAAERKMTDQINKPIMLIHFPKSLKSFYMKSLDDAPDFTESVDVLVPGVGEVVGGSMRISDLEELMAGYKREGIPADPYYWFTDQRKYGTTEHGGYGLGVERLLAWILKRYTVRECSLYPRFMGRATP

SEQ ID NO: 28041 - protein, 194 aa, Picrophilus torridus
MNRKDKYYIRAKRENYRSRASYKIIEINNKYNIVSRGDNVLEFGSSPGGWTQVIENITQSVIIAVDINRMDPVKNTVFIKMNIFDDDIFKSIDHAMAENNIKNFDSILSDAMSRTSGIEDRDHYNSYKICERVMDISIPRLKNGGNIILKQFQGDMTNEFIKKWSGYFNYYKITKPKASRQHSREIYIIFLNRI

SEQ ID NO: 28042 - protein, 176 aa, Medicago truncatula
MGHVIVLSQTTSEIHLHQLTPQCITTKTDSARLHEELHKLKVLAGAPKLYPDLVNLNVVPSIVDLLNHDNTDIAIDVVTLIQDLTDENVLDENDEPAKVLVDALVDSSALEPLVQNLHRLSEKDADENAAVYNTLAKIENLIEVKPRWRRWFVRRRCFLRIKEVCFFFVFGYFHKI

SEQ ID NO: 28043 - protein, 579 aa, Glycine max
MCGILAVLGCSDSSQAKRVRVLELSRRLKHRGPDWSGLHQYGDNYLAHQRLAIVDPASGDQPLFNEDKTVVVTVNGEIYNHEELRKQLPNHTFRTGSDCDVIAHLYEEHGENFMDMLDGISSFVLLDTRDNSFIVARDAIGVTSLYIGWGLDGSVWISSELKGLNDDCEHFESFPPGHLYSSKERAFRRWYNPPWLSLAIPSAPYDPLALRHAFEKLWIKRLMTDVPFGVLLSGGLDSSLVAAVTARYLAGTKAAKQWGTKLHSFCVGLEGAPDLKATKEVAEYIGTVHHEFHYTVQDGIDAIEDVIYHIETYDVTTIRASIPMFLMSRKIKSLGVKWVISGEGSDVFFGGYLYFHKAPNKEEFHQETCRTIIVLHRYDCSRANKSTFVWGLEARVPFLDKEFIRVAMNIDPECKMIKKEEGRIEKWALRRAFDDEEHPYLPKHILYRQKEQFSDGVGYGWIDGLKAHAEKHVTDRMMLNAANIFPFNTPTTKEAYHYRMIFERFFPQNSCRLTVPGGTSVACSTAKAVEWDAAWSNNLDPSGRAALGVHASAYGNQVKAVEPEKIIPKMEVSPLGVAI

SEQ ID NO: 28044 - protein, 271 aa, Solanum lycopersicum
MSEVVDQAPIAKQWRRVVVKVGTSSIVDAAGEIKYPVINRLAQTLTQLEQTGYEVILVTSGAIGVALKQMHQTKRPTEIPAQQALAAIGQSYLMAIYNQSFAFYQQHVGQVLLTYDVFHNKQMLRHTIDAIAAMLQQRVIPIINENDVIAVDELDHQHSFGDNDRLAAMVTHETNADALIVLSDIDALYTANPHVDPTAQPIPLVTAVTDSLRAGARGSSTLGTGGMATKLVAADYLLQHGRQMVLINGENPATILEVLAGEPVGTLFKGE

SEQ ID NO: 28045 - protein, 245 aa, Moorella thermoacetica
MRLGAAQMFIADSMAVNEATILRLAGEAAGRGVELLVFPEMGLTGYNPAALGRPGFKEELEGALARIARRAADLGVGLIVGRAEFAGERLFNSASVFLPDGSVHTYRKIYLTDAEARYFTPGTGHLVFNYKGSKFGVIICRDQNYPELARQIAAEGARALFILSAHYYQPGEARWKLPKNRALPIARAVENHCYVLLANAVGSHIGMVSLGNSLIADPEGGLVVMADEASETLLTCDLPGDSQCS

SEQ ID NO: 28046 - protein, 658 aa, Rhodospirillum rubrum
MCGLTGYWTRGGDGRGRGEMTALVLRMAGALAHRGPDGDGAWVDEDAGLALGHRRLSIVDLSPAGQQPMVSADGRLALAYNGEIYNAAELRPELEAAGIVFRGHSDTEVLLEGFARWGVVPTLRRAIGMFAFALWDRKERRLTLGRDRLGIKPLYVADHGGTLLFASQPKGMMPHPSWRGEVDREGLAAMLRLSCLPAPRSIFKGVSQLAPGTVVRFEADGRRSEEVFWSLEEVAARGVAQARSQPARPESASLAVEHLESLLLDAVRRRLIADVPVGAFLSGGVDSSTVVALMRKVASGPVKTFSIGFAEEGWDESVHAAAVARHLGTDHRELVVSPDEVPAIVGDLPRWYDEPFADASQIPTLLVSKLARSEVTVSLSGDGGDELFAGYNRHVQGQRLWDLAQRIPTVGRDLGAALIEAPSPGFWQRAVGLLPAGRRPPQAADKPAKIARLLRARSPEALYRTLVGAMPSAEVPLAGVSLAAEERWYAASAEGVDSFVDRMRLLDAKGYLPDDILTKVDRASMAYGLEARVPLLDHRVVEFAWSLPPEMLIREGQGKWLLRRVLHRHVPRALIERPKMGFGVPLAAWLRGPLRGWAEDLLDPQTMAVQGLIDPAPVRRWWLDHLAGRRDTHDRLWPVLSALSWHHHWKSAGAFTAA

SEQ ID NO: 28047 - protein, 606 aa, Triticum aestivum
  misc_feature (559)..(559): Xaa can be any naturally occurring amino acid
  misc_feature (571)..(571): Xaa can be any naturally occurring amino acid
  misc_feature (595)..(595): Xaa can be any naturally occurring amino acid
VTLQNKFVQKSRLVPVRNSRDIVDPRVRQFGAFIVLCGATHLINLWTFTMHTKTVAIVMTVAKVSTAVVSCATALMLVHIIPDLLSVKTRELFLKKKADELDREMGLIRTQEETGRHVRMLTHEIRSTLDRHTILKTTLVELGRTLGLEECALWMPSRSGSSLQLTHTLRHPIPGGSSVQINLPVVNQVFSSNRAIIVPHTSPLARIRPVQGRYVPPEVAAVRVPLLHLSNFQINDWPELSAKSYAIMVLMLPSDSARKWHVHELELVEVVADQVAVALSHAAILEESMRARDLLMDQNVALDLARREAEMAIRARNDFLAVMNHEMRTPMNAIIALSSLLLETELTPEQRLMVETVLKSSNLLATLINDVLDLSKLEDGSFELDISTFNLHAVFKEVMSFVKPIAAIKKLSVSAMLSPDLPLSAIGDEKRLMQTILNVCGNAVKFTKEGHISLVASVVKSDALREFRSTDFHPVATDGHFYVKVQVKDTGCGISPQDVSHVFTKFAHTQSGGNQGYNGSGLGLAICKRFVSLMGGHIWLESDGAGKGCTATFVVKLGXCDAYQQPAVPLXVCPSHAGSDPSGPSAAARWEERGXSNLKPRYQRSI

SEQ ID NO: 28048 - protein, 136 aa, Lilium longiflorum
MARTKQTARKSTGGKAPRKQLATKAARKSAPATGGVKKPHRFRPGTVALREIRKYQKSTELLIRKLPFQRLVREIAQDFKADLRFQSSAVAALQEASESYLVGLFEDTNLCAIHAKRVTIMPKDIQLARRIRGERA

SEQ ID NO: 28049 - protein, 309 aa, Desulfovibrio desulfuricans
MNIAENMAALVGNTPLVRLNRLARGCHAEVVAKLEFYNPCASVKDRIARSMIESALESGEINADSLLVEPTSGNTGVGLAFICAVHGLRLTLTMPESMSDERKKLLRSFGTTLVLTPAAQGMRGAIAEAERIVRETPGAVMLQQFANPANPAAHYATTAEEIWRDTDGRVDAFVAGVGTGGTITGTGRRLRELNAGVRIIAVEPEASPVLSGGAPAPHPIQGIGAGFVPEVLDTGIYDEVFKVSGDDAMNTARDLLRQEGILCGISSGANAFAALEAARRPEMKGKRIVFIVCDTGERYLSTPLFSGQS

SEQ ID NO: 28050 - protein, 177 aa, Lemna gibba
MASSMMASTAAVARAGPAQSNMVAPFNGLRSSVAFPATRKANKNLSTLPSNGGKVSCMQVWPPEGLKKFETLSYLPPLSVEDLAKEVDYLLRNDWVPCIEFSKEGFVYRENHASPGYYDGRYWTMWKLPMFGCTDASQVIAEVEEAKKAYPEYFVRIIGFDNKRQVQCISFIAYKPT

SEQ ID NO: 28051 - protein, 153 aa, Chlamydomonas reinhardtii
MAPKKDEKPPTQEAGAEAPAKAERKPKAEKAAKKAKKEPSKKAAKEPKGSGEKKDKKKKKSAVETYKLYIYKVLKQVHPDTGISSKAMSIMNSFINDIFEKVATEASKLSRYNKKPTVTSREIQTAVRLVLPGELAKHAVSEGTKAVTKFTSG

SEQ ID NO: 28052 - protein, 180 aa, Solanum lycopersicum
MASSVISSAAVATRSNVTQASMVAPFTGLKSSATFPVTKKQNLDITSIASNGGRVSCMQVWPPINMKKYETLSYLPDLSDEQLLSEIEYLLKNGWVPCLEFETEHGFVYRENNKSPGYYDGRYWTMWKLPMFGCTDATQVLAEVQEAKKAYPQAWVRIIGFDNVRQVQCISFIAYKPEGY

SEQ ID NO: 28053 - protein, 156 aa, Chlamydomonas reinhardtii
MAPKKDEKPATRAATQEAGVEATAKAEAKPKAEKAAKKAKKEPAKKAAKEPKGDGEKKDKKKKSAVETYKLYIYKVLKQVHPDTGISSKAMSIMNSFINDIFEKVATEASKLSRYNKKPTVTSREIQTAVRLVLPGELAKHAVSEGTKAVTKFTSG

SEQ ID NO: 28054 - protein, 153 aa, Chlamydomonas reinhardtii
MAPKKDEKPATAEAGAEAPAKAEAKPKAEKAGKKAKKEPAKKAAKEPKGDGEKKDKKKKKSAVETYKLYIYKVLKQVHPDTGISSKAMSIMNSFINDIFEKVATEASKLSRYNKKPTVTSREIQTAVRLVLPGELAKHAVSEGTKAVTKFTSG

SEQ ID NO: 28055 - protein, 180 aa, Pisum sativum
MASMISSSAVTTVSRASRGQSAAVAPFGGLKSMTGFPVKKVNTDITSITSNGGRVKCMQVWPPIGKKKFETLSYLPPLTRDQLLKEVEYLLRKGWVPCLEFELEKGFVYREHNKSPGYYDGRYWTMWKLPMFGTTDASQVLKELDEVVAAYPQAFVRIIGFDNVRQVQCISFIAHTPESY

SEQ ID NO: 28056 - protein, 178 aa, Aquifex aeolicus
MKEIRGKKLKLLLKEEDIKRRVKELAKEIESSYSWEEPIVVVGLLKGAFIFLADLVRAFDRFVFVEFMQVSSYGKGMKSSGTIKIVKDLDMDIEGKEVLLVDDILDTGLTMKEIHDYLLMKKPKVLKTCVFLDKKERRKVDFNADFVGFEVPDKFLVGYGLDWGEYGRNLPEVYMVED

SEQ ID NO: 28057 - protein, 153 aa, Chlamydomonas reinhardtii
MAPKKDEKPATAEAGAEAPAKAEAKPKAEKAAKKAKKEPSKKAAKEPKGDGEKKDKKKKKSAVETYKLYIYKVLKQVHPDTGISSKAMSIMNSFINDIFEKVATEASKLSRYNKKPTVTSREIQTAVRLVLPGELAKHAVSEGTKAVTKFTSG

SEQ ID NO: 28058 - protein, 230 aa, Solanum lycopersicum
MGTVGQEAAIDLLKSEIPAEEDEPLLLTGDVNTGLVLVDIVNGFCTVGAGNLAPVTPNRQISAMVDESVKLAKVFCEKKWPIYALRDSHHPDVPEPPNPPHCIAGTDESELVPALQWLENEPNVTVRCKDCIDGFLGSIEKDGSNVFVNWVKANEIKIILVVGICTDICVLDFVCSVLSARNRGFLSPLKDVIVYSPGCATYDLPVQIARNIKGALPHPQDTATAIADTA

SEQ ID NO: 28059 - protein, 180 aa, Unknown
  Petunia x hybrida
MASSVMSSAAVATSTNAAQASMVAPFTGLKSAASFPVSRKQNLDITSIASNGGRVQCMQVWPPYGKKKYETLSYLPDLTDEQLLKEIEYLLNKGWVPCLEFETEHGFVYREYHASPRYYDGRYWTMWKLPMFGCTDATQVLGELQEAKKAYPNAWIRIIGFDNVRQVQCISFIAYKPPGY

SEQ ID NO: 28060 - protein, 662 aa, Dianthus caryophyllus
MSFFENMGYYPNFEFPPQATVVREEEPVAEVEQEGNDEDYSDDDVDVDELERRMWRDKMLLKRLKEQNKDRCREGIDNVKKRQSQEQARRKKMSRAQDGILKYMLKMMEVCKAQGFVYGIIPEKGKPVSGASDNLRAWWKDKVRFDRNGPAAIAKYQADHLVQGMDEDCTAMGSTPHTLQELQDTTLGSLLSALMQHCDPPQRRFPLEKGHPPPWWPVGNEIRLPGLGIPNDQGPPPYKKPHDLKKAWKVSVLTAVIKHMSPDIEKIRKLVRQSKCLQDKMTAKESATWLAIVNQEESLARKLFPDRCPPPAPGGGGSLVISDTSDYDVDGAGPDSSSDVEDCKPQNINVFNFREKFMGHPVNMITPAIKGEVVETGFDFPVKRKQPSSGSQTVIDQKVFLCENPQCPYNDPCLGFPDRILRHDHQLNCPFRSRGVEVTNTQTTLEKHPSSESTNFTSSFAQQEKFSLQSAMQSPATFNPCTGTVLETGDQLQQNMQRKTTDGRFVGQGSALYGNSTYLGQQSQFQIDNVGFFASHGGNGSQGMFVNGKNNNQVKQKPSLQMSNGFNGVSPSRQQMQAPMDGGFRGLSNMSGNIPQRTKTSAGHPVFSSGGMQQQQQLDQCRTFDSSFPMHLNDDITDFGFNSPFNIDFEPLLRPDNPIWNI

SEQ ID NO: 28061 - protein, 135 aa, Chlamydomonas reinhardtii
MARTKQTARKSTGGKAPRKQLATKAARKTPATGGVKKPHRYRPGTVALREIRKYQKSTELLIRKLPFQRLVREIAQDFKTDLRFQSQAVVALQEAAEAYLVGLFEDTNLCAITAKRVTIMPKDIQLARRIRGERA

SEQ ID NO: 28062 - protein, 564 aa, Pichia angusta
MTIESQEPWWKSAVVYQVWPASFKDSNGDGIGDLNGITSELDHIKSLGTDVIWLSPHYASPLDDMGYDISDYNAINPQFGTMEDMDRLLAEIKKRDMRLILDLVINHTSSEHAWFKESRSSRDNPKRDWYIWKDNANNWLSFFSGSAWSYDEKTKQYYLRRFAETQPDLNWENPKTREAIYKSALEFWYEKGVSGFRIDTAGLYSKVQTFEDAPVTFPGEKYQPAGPLINSGPRIHEFHKEMYEKVTSRYDAMTVGEVGHCSKADALKYVSAKEKEMNMMFLFDTVDVGSDKSDRFRYKGFTLTDFKDAIINQSNFIFDDETGELNDAWSTVFIENHDQPRCVTRFGNTSNKLFWSRSAKMLALLQTTLTGTLFVYQGQEIGMTNVSPKWDISEYLDINTINYWNAFNETEHSDEEKAELLKIINLLARDNARTPVQWDSSENGGFGGKPWMRINDNYKDINVASQKEDPDSVLNFYRNAIKTRKHYSETLIFGRFEVQDYDNQEIFYYTKTSNKGQKKMAVVLNFTDREVEYPIPQGKLLLSNIANNITGKLQPYEGRLIEVN

SEQ ID NO: 28063 - protein, 72 aa, Lactococcus lactis
MAKDDVIEVDGKVVDTMPNAMFTVELENGHQVLATISGKIRKNYIRILPGDKVQVELSPYDLTRGRITYRFK

SEQ ID NO: 28064 - protein, 323 aa, Desulfitobacterium hafniense
MTNTVRKIAVLTSGGDAPGMNAAIRAVVRKGIYHGLEVLGIRKGYEGLIHGEFITMHLGAVADIIHRGGTMLMTARSQEMLTPEGQKNAAAQLRYRGIDALIVIGGDGSFRGAQTLSAQGIAIVGIPGTIDNDITGTDLTIGFDTAVNNVVQAVSKIRDTATSHDRTFLVEVMGRDCGNIALQSGVACGAESILVPEIEPDLDDIVAKLERGHQRGKHHSIIMVAEGAMSAWNLGEELRQRTGFETRVTILGHIQRGGNPSALDVVLASQMGGKAVEILCAGETDRMTACVNQEIQSLPLEVAYGERKPFNKVLYDLANQLAI

SEQ ID NO: 28065 - protein, 459 aa, Synechococcus elongatus
MTGVENVVIIGSGPAGLTAAIYAARANLKPLMFEGYQLGGLPGGQLMTTTEVENFPGFPEGITGPELMERMRAQAVRWGAELYTEDVISADLSQRPFRIRSQEREVLAHSVIIATGATARRLSLPGEDRLWNNGISACAICDGAAPIFRDGELVVIGGGDTAAEEAVYLTKYAKHVHLLVRSDRMRASKAMQDRVLAHPNVTVHWHTEAIEAVGNTLLEAVRVRNNQTGEEKAIAAQGLFYAIGHTPNTKLFEGQIELDGTGYIRTKPDSVETSLEGVFAASDVQDHEYRQAITAAGTGCAAALLAERYLSAHNLLQEYKQEAAAAEPETKAAATPAASQPEASEFDPTSVYHEGSYALRKLYHESDRLLAVLYTAPTCGPCRTLKPILRKVAEEFSDRLHYVLIDIDADPEIAQSAGVVGTPTLQLFKDKAKVDEIRGVKMKSDYRARFEQHLQPVSR

SEQ ID NO: 28066 - protein, 509 aa, Ammi majus
MALFLYLIIPCTIILLHQLYHKLRFKLPPGPRPWPIVGNLYDIEPVRFRCFNNWSKTYGPIISVWFGSTLNVIVNNTELAKEVLKDKDQQLADRHRSRSAAKFSRDGQDLIWADYGPHYVKVRKVCTLELFTPKRLEAIRPVREDEVTAMVESIYKDCTNSDTIGKSLLVRQYLGGVAFNNITRLAFGKRFVNSEGVMDEQGKEFKSIIANGLKLGASLATAEHIQWLRWLFPLEEEAFAKHGARRDNLTRAIMEEHTLARQKSGGTKQHFVDALLTLQSKYDLSEDTIIGLLWDMITAGADTTAIVVEWGMAELIKNPRVQEKAQEELDRVIGYERVLTELDFSNLPYLQCVAKEALRLHPPTPLMLPHRANANVKIGGYDIPKGSNVHVNVWAVARDPAVWKNPLEFRPERFLEEDVDMKGHDYRLLPFGAGRRVCPGAQLGINLVTSMLGHLLHHYSWAPPSGLSSDEIDMSESPGMVTYMKTPLQAVPTPRLPSQLYKRLAVEDM

SEQ ID NO: 28067 - protein, 469 aa, Bacillus anthracis
MFQKDFRLYDNPALFEAAQSGEVVPVYVHDETFSMGSASKWWLHHAIIDVKKQLEALGSTLIIRKGSTQEEILSLVEQLGITAVYWNICYDPDRLQSNQKMKMMLEHKGMICKEFNSHLLLEPWVIKKKDNTEYKVFTPFYNAFQKQVIHKPISKVQSIKGGNSLPVSLSVSELHLLPTIPWTSHMESIWEPTEEGAYKTWKEFFSSKLASYSEGRDFPNQNAHSMLAPYLSFGQISVKLIYHYLINKSTESQCSLFEKQVNSFIRQLIWREFSYYLLYHYPFTAYKPLNKSFEHFPWNNEEELLRVWQKGDTGYPFIDAGMRELWQTGFMHNRTRMAVASFLVKHLLIPWQEGAKWFMDTLLDADIANNTMGWQWVAGSGADASPYFRIFNPITQGEKFDKNGEYIRKWVPELKDMPNKYIHKPWEAPEHILQKANIQLGHTYPLPVVDHKAARERALCAYKSMKEFV

SEQ ID NO: 28068 - protein, 471 aa, Cucumis sativus
MEDDYSIFPPDSDLDFSFTSTTTDRTFTTSSSARTSLARSSLTLSFNESRLSAAAAALNLRPYHRSDSHWSAIRAATTLSSDGHLHLRHLKLIRHLGTGNLGRVFLCHLRDNDHASFALKVVDKEALSNKKLLQVQTEAEILASLDHPFLPTLYARLDVSHYTCLLIDYCPAGDLHSLLRKQPGSRFSVAAARFFAAEVLVALEYLHALGIVYRDLKPENVLLREDGHVMLSDFDLCFKSDVVPTFHTWTRPGPQATGSCFGWRTSPEFEEEIVGEFVAEPTSAFSKSCVGTHEYLAPELVTGGGHGNGVDWWAFGVFVYELLHGTTPFKGVNKEGTLRNIASSEGVKFRGGGEEEGGMGEARDLIERLLVKDPGRRLGWEKGATEIKRHPFFEGIKWPLIRTYRVPEVYGMMRKGRAQVSHVREVTERIRRRGWWNWRKVMRKRLIKNGSCSKSHSNTNYYSYSSKKKTG

SEQ ID NO: 28069 - protein, 275 aa, Unknown
  Mycobacterium sp. KMS
MREVRPFTNRRRVSAVKAGDRRVAIVTAAAAGIGKAIALRWCREGGCCVMADTDGEGLDAAVHELAESGAAVCGVAGDVCLSDVANSVVERALTEFGRLDTLFNVVGGSLARNVEEISEEQWRSQIDMNLGSVFQMSKPVIPLLRQGGGGSIVNVASTAGILAENRCSAYSASKGGVVLLTKNMALDFARDNIRVNAIAPGGTRTPRIERFLAEHPEHASMMVDLCAMQRFAGPDEIAAPAVFLASPEASYITGAVLPVDGGMTAGVTFRAFEAV

SEQ ID NO: 28070 - protein, 199 aa, Pisum sativum
LDEYSKFHGYSPAVVTGKPIDLGGSLGRDAATGRGVLFATEALLNEYGKSISGQRFVIQGFGNVGSWAAQLIDEKGGKIVAVSDITGAIKNSKGIDIPSLLKHTKETRGVKGFHGADSIDSNSILLEDCDVLIPAALGGVINRENANEIKAKFIVEAANHPTDPEADEILKKKGVVILPDIYANSGGVTVSYFEWVQNI

SEQ ID NO: 28071 - protein, 895 aa, Ustilago maydis
MPSISPQHTAEPSSSTQSTLHSTPAVSQVRIQTPEAPASLDELLKSPHNPALQIRQPSSTLRGATPDDQRRRNGFHLWRTESEDARNARLRQAIQAAEAQANAPPSLKHRLGNALGKASDWIQSRGFLSLYRLNPIQLGDGTEAILSDAFAVRSPKLSRLGLIVLTISLAGAQLAWTLELAYGTPYLLSLGLSQQSTSLVWLAGPLSGLIAQPVVGSLSDHSTSSFRRRKYMIISALLLTVSTITLAYSVPISTSLVDLFGGGLADWDPRRHDLVHSTTQIISVMAFWILDFALNGLQAASRALILDTAPSEQQTIANAWQGRMTHAGNVVGYLCGWVDLASWKSLRWLGGGQFRRFAMISLLAMISCVSVTISCISESPTDDRFSQSTHQRQSMCTSAWSTAQATLDDVWHAIRRLPRSVRRVCLVQLFAFMGWFPFLFYSTTYILQIAQYERNLEHRRTHDDLILVQPFDAGQGGQAGRPSSDRDAERGSFAMLMFALISLVSAALLPYLALAGEKRDQPCLKNADSNNGQETPTPPLQINIPADRASLWSEPRHTADREHSERISRVQRVTRGLVQGLTLRTFWSVASIVFAALMLVGTAWASTVRQATVVIALVGVPWSVAAWAPFALVGEFVREAEDGASPFEFEQDHWSPARMRARAAATEEGRPRKHSQPSAHESVSRVDQADVGAGGGFKYIDQVSPTRMGRGGEQGARERIRASLVDCAPLPRTSTASSEDVESLHVAPHCGDGGGWRSSSYSSHAPTPQNATGGAGTILGIHNLAIVAPQFVVAIIASLIFSAVHSSLSATHLVLNSPALASLADRDHRVAQGGVVNPAKGTVWVLRFGGSMALIAAVVARFVPLTLSERQRRYPAQQPIQHHAAGQHDDYRDVL

SEQ ID NO: 28072 - protein, 537 aa, Bacillus clausii
MTYFTDFDISDQVKQAIQDMGFEEPSPIQEKAIPAILTGGDVIGQAQTGTGKTAAFGIPVVDKVTEERYIQALILTPTRELAIQVSGELQKLSAHKRIRTLPIYGGQSIGHQIKALRQGVQVVIGTPGRMLDHLRRGTLKLNSVHTVVLDEADEMLDMGFVDDIEAILKEVNQVRQTLLFSATMPPAIRKLSRKYMNDPKTVTINKGEVTAPSINQVYYKVLERNKIDSLCRIIDSDDVELGILFCRTKKGVAELTEALQARGYLVDGLHGDLTQSQRDVVMKKFRDSSIEFLIATDVAARGIDVENVTHVINYDIPQDPESYVHRIGRTGRAGRTGAAITLVTPREMKHLRSIEKEIKMHIPSASVPTIEEVVEKQQSSWKNLIQDTIEQGGKEMELFLPLVDEILAEQDPKQVVAALLKLKFSTETATEDAGYSFGDTGGAKGMVRFFINVGRNVNLTPKILGEEIGRLVGIPVKSIGRIDIFENFSFVDVPEEAAPFVYEGLRYSRINGARVNLEPAKPRPKRERRTPAGSRRS

SEQ ID NO: 28073 - protein, 274 aa, Mycobacterium avium
MTRRTIVITGASDGIGAAAARRLSRAGDRIVVVGRSQTKTAAVAAELGADHFVVDYADLSQVRALADKMRAQYPRIDVLLNNAGGVASRIELTADGYERTYQVNYLAPFLLTTQLLDVLLESRATVVNTTSSSHKLILRATVDDLENTANRRPAVAYAYSKLAIVLFTKELHRRYHARGLSVAAVHPGNVNSNIGIASGSRFLVFMQRYTPAALFISSPDQGADPLVRLASSPPDSEWTSGAYYAKRKIGKTTRLADDPRLAAELWERTAARLG

SEQ ID NO: 28074 - protein, 351 aa, Listeria monocytogenes
MYEACGGCQLQHVAYSAQLELKRDIVIQSIEKHTKIDPTKLKIRPTIGMEDPWRYRNKSQFQTRMVGSGQVETGLFGANSHQLVPIEDCIVQQPVTIKVTNFVRDLLEKYGVPIYDEKAGSGIVRTIVVRTGVKTGETQLVFITNSKKLPKKREMLAEIEAALPEVTSIMQNVNQAKSSLIFGDETFLLAGKESIEEKLMELEFDLSARAFFQLNPFQTERLYQEVEKALVLTGSETLVDAYCGVGTIGQAFAGKVKEVRGMDIIPESIEDAKRNAEKNGIENVYYEVGKAEDVLPKWVKEGFRPDAVIVDPPRSGCDQGLIKSLLDVEAKQLVYVSCNPSTLARDLALLA

SEQ ID NO: 28075 - protein, 248 aa, Cocos nucifera
MGYLNSIAGIQADGSPVSGGGLSRNGKFSYGYASSPGKRASMEDFYDTRIDGDDGEIVGLFGVFDGHGGARAAEYVKQNLFSNLIRHPKFISDTKLAIADAYNHTDSEFLKSENNQNRDAGSTASTAVLVGDRLLVANVGDSRAVICRGGNALAVSKDHKPDQSDERQRIEDAGGFVMWAGTWRVGGVLAVSRAFGDRLLKQYVVADPEIQEEVVDGSLEFLILASDGLWDVVSNEEAVAMIKPIEDP

SEQ ID NO: 28076 - protein, 502 aa, Oryza sativa
MASITSELLFFLPFILLALLTFYTTTVAKCHGGHWWRGGTTPAKRKRMNLPPGAAGWPLVGETFGYLRAHPATSVGRFMEQHIARYGKIYRSSLFGERTVVSADAGLNRYILQNEGRLFECSYPRSIGGILGKWSMLVLVGDPHREMRAISLNFLSSVRLRAVLLPEVERHTLLVLRAWLPSSTFSAQHQAKKFTFNLMAKNIMSMDPGEEETERLRREYITFMKGVVSAPLNLPGTPYWKALKSRAAILGVIERKMEERVEKLSKEDASVEQDDLLGWALKQSNLSKEQILDLLLSLLFAGHETSSMALALAIFFLEGCPKAVQELREEHLGIARRQRLRGECKLSWEDYKEMVFTQCVINETLRLGNVVRFLHRKVIKDVHYKGYDIPSGWKILPVLAAVHLDSSLYEDPQRFNPWRWKSSGSSGGLAQSSSFMPYGGGTRLCAGSELAKLEMAVFLHHLVLNFRWELAEPDQAFVFPFVDFPKGLPIRVHRIAQDDEQE

SEQ ID NO: 28077 - protein, 287 aa, Unknown
  Synechococcus sp. CC9311
MTTAPETSGNWIDEHHNGVRYGLEGRVLVEETSPFQRITVIDSQRYGKGLLLDGCWMTAEHQERHYHEALVHPALCSAKAIERVLVIGGGDGGTARECLRYPGVKHLDMVEIDGRVVDLSQEHLPSIGGGCWHDPRFHLTIGDGIAWAAEAENAFYDVVLVDGSDPTGPAEGLFNRAFFSNCCRILKPGGVFATQSESPEAFRQVHIDMVKLIRELFGHADPLYGWVPMYPSGWWSWTFAAKDAPRYLTVQSERAAAVAEGSAIWSPRWQQGAFNTIPAFIERELNQ

SEQ ID NO: 28078 - protein, 471 aa, Arabidopsis thaliana
  misc_feature (374)..(374): Xaa can be any naturally occurring amino acid
  misc_feature (398)..(398): Xaa can be any naturally occurring amino acid
RVDPRVRVFADPSVAERVIMDKHIIDGRTVEAKKAVPRDDQQVLKRHASPMHLISPSHGGNGGGARTKKIFVGGLPSSITEAEFKNYFDQFGTIADVVVMYDHNTQRPRGFGFITFDSEESVDMVLHKTFHELNGKMVEVKRAVPKELSSTTPNRSPLIGYGNNYGVVPNRSSANSYFNSFPPGYNNNNLGSAGRFSPIGSGRNAFSSFGLGLNQELNLNSNFDGNTLGYSRIPGNQYFNSASPNRYNSPIGYNRGDSAYNPSNRDLWGNRSDSSGPGWNLGVSVGNNRGNWGLSSVVSDNNGYGRSYGAGSGLSGLSFAGNTNGFDGSIGELYRGSSVYSDSTWQQSMPHHQSSNELDGLSRSYGFGIDNVGXDPSAMPQKVLRNYNVGNRQTHRGXKHRKKSTKRSENCRSRRTAISVAEFEELLFRYQVEKETNFLHHSEFLVLFFSSLASQTQKREVYFYFKNSYIR

SEQ ID NO: 28079 - protein, 136 aa, Unknown
  Shewanella sp. ANA-3
MSQLLHTMLRVGNLERSIAFYTQVLGMKLLRTSENPEYKYSLAFVGFGEESTGQAVIELTYNWGTEKYDLGTAFGHIAIGDEDIYARCEAIAAAGGKVTRAPGPVAGGTTEIAFVEDPDGYKIEFIQMKSATQGLG

SEQ ID NO: 28080 - protein, 526 aa, Unknown
  Photobacterium sp. SKA34
MLEQSMKQQLKAYLENLKTDIQLVLSLDDSDTAQKLHELAHEIAELNDKVSVIEDNNASERKPVMQVVNPTKQTSISFAGLPMGHEFTSLVLALLHSGGHPMKIEQAVIDQIAALDQDIVVETFISLSCQNCPDVVQAFNMMAAINPRIKASMIDGAAFQDEVTERNIMAVPTIYVNGEVFGQGRMSLTEILNKLDTGAAKKVAANLNEKAPFDVLVVGGGPAGASAAIYAARKGIRTGVVAERFGGQVMDTMSIENFISVKETQGPRLAASLEEHVKQYNVDIMSEQRVNNIVEAADTEDGYTHVYLESGAMLKARSVIISTGARWREMNVPGEQEYRNKGVAYCPHCDGPLFKGKRTAVIGGGNSGIEAAIDLAGIVEHVTVLEFADTLRADQVLINKAESMPNIDIIKMAQTTEVVGDGTRVTGISYKDRNTDEIKHIELAGIFVQIGLVPNTEWLKESVVALTPRGEIEIGAHGNTNVNGIFAAGDVTTVPYKQIIIAMGEGAKASLGAFDYLIRTPVPNNK

SEQ ID NO: 28081 - protein, 510 aa, Photorhabdus luminescens
MCGIGGVFNTENRLIDDIENKLQTIMSKIAHRGDPSRFNEKVVRNNFSIATNRLAIVERDSAYQPISNQEHDLHLVLNGQIYNYKSLRNELIKQGYQFKNGGDAEVALIAYICYGKSFIKKLDGMFSFILFDNKNNKFLLGRDHVGIKPLYYTQKEGNWYVASEIKSLIEFNSEIKPVEPGSIFDGLTSEKYISYDTTIPASSDNVEQAKEKIYSLLDNAVRKRVDTDLPVSIMFSGGIDSTIVLYLAKKYHHDITAISFGLPGSKDIEIAQRYCTENNIKHIIYTFTQEELINNIQDAIYYGEFFEQIDAIDSTIAHFGYYIANRLGFKIALCGEGSDEIFAGYDLFKTYPDPHHLSLYRLNNLHRTDLQRVDRASMRNTVEARVPFMDSALVPYVLSLDFSYKLNNGIEKYILREAFRGKIPEYIIDRPKIRMPDGSGVKNTIIDYVKDIKCNLPRNMVDSLNSIGLTHQSSLYFAEKYLSLGYPLPKERFKESGKDFSESGYFNFIS

SEQ ID NO: 28082 - protein, 103 aa, Chlamydomonas reinhardtii
MSGRGKGGKGLGKGGAKRHRKVLRDNIQGITKPAIRRLARRGGVKRISGLIYEETRTVLKTFLENVIRDSVTYTEHARRKTVTAMDVVYALKRQGRTLYGFGG

SEQ ID NO: 28083 - protein, 739 aa, Silicibacter pomeroyi
MSLVNKLAEERRARLAAERLLELKQAELSAANRKLGRHALALTKQIGEKQAEVATVRDENEKVKSDLTVANAKIEVAERRLWHSIQTIQDGFAFFDSDSKLIGANTAYLNVFDGLDEVAPGISYMRILQLMTEEGIIDTGELAAEEWRQMMHERWISPTPEPVVIRMWNDQYVKMIDQRGHGGDVVSLALNITSTVRYEAELRAAREKAEAANRAKSAFLANMSHEIRTPMNGVVGMAELLCDTALDEEQQLYASTIKNSGEALLVIINDVLDYSKIEAEKMMLHPEPFDLERCIHEVAMLMQPIVRDKGLTLLVDYDLFLPTLFVGDPGRVRQVLTNLLGNAVKFTTKGHILIRVTGVPDPATGRCAIHVAIEDTGIGIPREKLAHIFGEFNQVENERNRQFDGTGLGLAISQRLIQMMGGTVWVESEEGRGSCFGFRVTLPMSEEAQPVLPNLPGRLQHVLIVDDLAVNRAILEKQLAQLGVRVTCCASGAQALEKMSDCVDLVLSDHNMPEMDGLELAEALRGAGWSDLPIFLLSSNPGMAHADPAKRHVQGILQKPIPRAELFARLSDMRTEITSVQDPAAVSAPVTKPAQDAPGEPTERRQMRVLAAEDNRTNQLVFRKMVKTLDIDLRFANNGLEAVEIWQDFQPDLIFMDISMPKMDGKQATGEIRRLEAGTGRHVPIVALTAHAMAGDAEGILAAGLDQYLTKPLRKALIHQHIAEACPAGALPVEPESGE

SEQ ID NO: 28084 - protein, 263 aa, Rhodospirillum rubrum
MSSAEGPKSGGGSKGSKSEASSRVRGSAPTGSRDLFVRVRTAKGRKASSTRWLQRQLNDPYVLEAKRQGLRSRAAFKLIELDERFTLLKPGMRVVDLGAAPGGWTQIAVERTRSLHPNGGKVVGMDILEWEGVAGATCLTHDFMDDAAPLMLKGAMDGAVDLVLSDMAAPTTGHRQTDHLRVMGLAEAAWYFAEEVLAPGGAFVCKVFQGGTEGALLTRMKKMCEVIRHAKPPASRQGSPEVYVIAQGFRGLSGGEDTGRDES

SEQ ID NO: 28085 - protein, 382 aa, Haemophilus influenzae
MAKKDYYEVLGLQKGASEDDIKRAYKRLASKHHPDKNQGSKEAEEKFKEINEAYEVLGDDQKRTAYDQYGHAAFEQGGGAGGFGGGFGGADFGDMFGDIFGDIFGGGGRGRQRVVRGEDLRYDLEISLEEAVKGTTKDIQINTLAHCDSCGGSGAEKGSKVETCPHCHGSGRIRRQQGFFVSESICPTCHGSGKKIEKPCRSCHGEGRVHKKENLSVKIPAGVDTGNQLRLAGKGAAGENGAPAGDLYVVIHVREHHIFERDGSNLYCEVPISFATAALGGEIEVPTLDGRVKLKIPAETQTGKLFRMRGKGVASTRSGYAGDLICRIVVETPVNLTSEQKELLHKLEESLQGKDLSKHAPKSSGFLDGVKKFFDNLGKSDK

SEQ ID NO: 28086 - protein, 1004 aa, Oryza sativa
MAAAATSTLLLLLLLLLATATHGAAADTVSSPASPEAAALLNLSAALGDPSGYLSTHWTHDTAFCSWPRLSCDADGSRVLSLDLSGLNLSGPIPAAALSSLSHLQSLNLSNNILNSTFPEGLIASLKNLRVLDFYNNNLTGALPAALPNLTNLVHLHLGGNFFFGSIPRSYGQWSRIKYLALSGNELTGEIPPELGNLTTLRELYLGYFNSFTGGIPPELGRLKELVRLDMANCGISGVVPPEVANLTSLDTLFLQINALSGRLPPEIGAMGALKSLDLSNNLFVGEIPASFASLKNLTLLNLFRNRLAGEIPEFVGDLPNLEVLQLWENNFTGGVPAQLGVAATRLRIVDVSTNRLTGVLPTELCAGKRLETFIALGNSLFGSIPDGLAGCPSLTRLRLGENYLNGTIPAKMFTLQNLTQIELHDNLLSGELRLDAGVVSPSIGELSLYNNRLSGPVPVGIGGLVGLQKLLVAGNRLSGELPREIGKLQQLSKADLSGNLISEEIPPAIAGCRLLTFLDLSGNRLSGRIPPALAGLRILNYLNLSHNALDGEIPPAIAGMQSLTAVDFSDNNLSGEVPATGQFAYFNATSFAGNPGLCGAFLSPCRSHGVATTSTFGSLSSASKLLLVLGLLALSIVFAGAAVLKARSLKRSAEARAWRLTAFQRLDFAVDDVLDCLKEENVIGKGGSGIVYKGAMPGGAVVAVKRLPAMGRSGAAHDDYGFSAEIQTLGRIRHRHIVRLLGFAANRETNLLVYEYMPNGSLGEVLHGKKGGHLQWATRYKIAVEAAKGLCYLHHDCSPPILHRDVKSNNILLDAEFEAHVADFGLAKFLRGNAGGSECMSAIAGSYGYIAPEYAYTLKVDEKSDVYSFGVVLLELIAGRKPVGEFGDGVDIVHWVRMVTGSSKEGVTKIADPRLSTVPLHELTHVFYVAMLCVAEQSVERPTMREVVQILTDLPGTAAAAAAAATAMDAPSHGSGKEQDRSAEMQQQDGSRESPPQQDLLSI

SEQ ID NO: 28087 - protein, 239 aa, Prochlorococcus marinus
MFPSWLTPKASKEAPIPSETEQHAVLGTGLHDPLTTDHEDALFACGCFWGAEKGFWKLPGIITTAVGYAGGHQEQPTYQEVCSGRTGHTEIVRVVWNKSVIDFSDLLKLFWECHDPTQGNRQGNDRGSQYRSAIYTTTIQQMELAQASRDSFQQLLSKGGFGAITTEIKADQQFHYAESYHQQYLAKPGSRPYCSAMPTQVALNDFPGANFKLPVSVWQEYDWSVSHCVLRSGNEIIKL

SEQ ID NO: 28088 - protein, 432 aa, Salinibacter ruber
MSALRNQDPEIHDVIQKEVQRQNDGLELIASENFASRAVMEAMGTALTNKYAEGLPGKRYYGGCEVVDRAEELARERAKELYDCDWVNVQPHAGAQANSAVYLTLLDPGDTFLGLDLSHGGHLTHGSPVNFSGILYEAEYYGVEEETGRIDMNRVRDRAKEVQPKMISIGASAYPRDFDYEAFREIADEVGAFLWMDMAHTAGLIAGGVLNDPMPHTHVVTTTTHKTLRGPRGGMILLGDDYENPMGKTARKSGRTKMMSELLDSAVFPGTQGGPLMHVIAAKAVGFKEALKPSFAEYTQQVVDNAQAMGAELRERGYDLVSDGTDNHLVLIDLRNKGLTGKEAEQALEAAGITANKNMVPFDDKSPFVTSGLRLGTPAMTTRGFGPDEFAHVAEMIDRVLQDPEDEDTQAAVEREVKALCDQHPLYDVAMA

SEQ ID NO: 28089 - protein, 152 aa, Haemophilus influenzae
MQTTTRTLTQHKRIALVAHDSCKKNLLNWTQKHKEALKSHILYATGTTGHILERETGLSIQSLLSGPMGGDQQLGGLIAEKKIDMMIFFWDPMNAAPHDPDVKALMRIATVWNIPVAINQSSADFLLTSVLFEQDVEIEVPDYEGYLKERLA

SEQ ID NO: 28090 - protein, 828 aa, Escherichia coli
  misc_feature (185)..(185): Xaa can be any naturally occurring amino acid
MKLSRRSFMKANAVAAAAAAAGLSVPGVARAVVGQQEAIKWDKAPCRFCGTGCGVLVGTQQGRVVACQGDPDAPVNRGLNCIKGYFLPKIMYGKDRLTQPLLRMKNGKYDKEGEFTPITWDQAFDVMEEKFKTALKEKGPESIGMFGSGQWTIWEGYAASKLFKAGFRSNNIDPNARHCMASAVXGFMRTFGMDEPMGCYDDIEQADAFVLWGANMAEMHPILWSRITNRRLSNQDVTVAVLSTYQHRSFELADNGIIFTPQSDLVILNYIANYIIQNNAINQDFFSKHVNLRKGATDIGYGLRPTHPLEKAAKNPGSDASEPMSFEDYKAFVAEYTLEKTAEMTGVPKDQLEQLAQLYADPNKKVISYWTMGFNQHTRGVWANNLVYNLHLLTGKISQPGCGPFSLTGQPSACGTAREVGTFAHRLPADMVVTNEKHRDICEKKWNIPSGTIPAKIGLHAVAQDRALKDGKLNVYWTMCTNNMQAGPNINEERMPGWRDPRNFIIVSDPYPTVSALAADLILPTAMWVEKEGAYGNAERRTQFWRQQVQAPGEAKSDLWQLVQFSRRFKTEEVWPEELLAKKPELRGKTLYEVLYATPEVSKFPVSELAEDQLNDESRELGFYLQKGLFEEYAWFGRGHGHDLAPFDDYHKARGLRWPVVNGKETQWRYSEGNDPYVKAGEGYKFYGKPDGKAVIFALPFEPAAEAPDEEYDLWLSTGRVLEHWHTGSMTRRVPELHRAFPEAVLFIHPLDAKARDLRRGDKVKVVSRRGEVISIVETRGRNRPPQGLVYMPFFDAAQLVNKLTLDATDPLSKETDFKKCAVKLEKV

SEQ ID NO: 28091 - protein, 366 aa, Clostridium perfringens
MMQPIKKIAILTGGGDCPGLNAVIRAVTRTAILKYGYEVIGYKFGYRGLYNNDFVKLDLDSVSGILHRGGTILHSSNKDNLFDYQVEDENGKIVKKDVSDVGVENLKKEGVDALVVIGGDGTLTSARDFSRKGVNVIGVPKTIDNDLLATDVTFGFNTATEIATEALDRLHTTAESHHRIMLLEVMGRNAGWIALESGIAGSADVILLPEIPYDINKIVEKVKEREEAGKQFTIIVVAEGAKPKDGEVVVSKIVDDSPDPIRLGGIANKLAIDLEGLIKNHEIRSTVLGHIQRGGNTSTYDRILSTKYGVKAVELINSNLFGNMVALKGNKVSYESLENVIGHTKNVDPEGELVNTAKSIGISFAD

SEQ ID NO: 28092 - protein, 150 aa, Zea mays
  misc_feature (39)..(39): Xaa can be any naturally occurring amino acid
MAPKAEKKPAAKKPAEEEPAAEKATAGKKPKAEKRLPAXGKSAGKEGGEKKGKKKAKKSVETYKIYIFKVLKQVHPDIGISSKAMSIMNSFINDIFEKLAAEAAKLARYNKKPTITSREIQTSVRLVLPGELAKHAVSEGTKAVTKFTSS

SEQ ID NO: 28093 - protein, 197 aa, Brassica napus
DPIAAVESSSSTPENYPHSSPRRLTRLAKLFNRVLRSKKVQTLEPNRLFVAEPVTARSGSFVGTHEYVAPEVASGGSHGNAVDWWAFGVFLYEIIYGRTPFAAPTNDVILRNIVKRPLSFPTDSAATMFELHARSLISGLLNKDPSKRLGSRRGAAEVKVHPFFKGLNFALIRTMTPPEVPSDVRRPKKSATFGGRS

SEQ ID NO: 28094 - protein, 232 aa, Solanum lycopersicum
MDNNPHQSPTEAAAAAAAAAAAAQSATYPSQTPYHHLLQQQQQQLQMFWTYQRQEIEQVNDFKNHQLPLARIKKIMKADEDVRMISAEAPVLFAKACELFILELTIRSWLHAEENKRRTLQKNDIAAAITRTDIFDFLVDIVPRDEIKDEGVGLGPGIVGSTASGVPYYYPPMGQPAPGGVMLGRPAVPGVDPSMYVHPPPSQAWQSVWQTGDDNSYASGGSSGQGNLDGQI

SEQ ID NO: 28095 - protein, 549 aa, Haemophilus influenzae
MSESFAQLFEESLKGLETRQGSIVGGTVVAIQKGFVLVDAGLKSESAIPVAEFLNAQGELEIQVGDTVNVALDAVEDGFGETKLSREKAVRHESWIELEKAYEEKATVIGLINGKVKGGFTVELNGVRAFLPGSLVDTRPAREADHLLGKELEFKVIKLDQKRNNVVVSRRAVIESENSQEREQVLENLVEGSEVKGIVKNLTEYGAFVDLGGVDGLLHITDMAWKRVKHPSEIVNVGDEVTVKVLKFDKDRTRVSLGLKQLGQDPWAAIAENHPVNSKLTGKVTNLTDYGCFVEILDGVEGLVHVSEMDWTNKNIHPSKVVSLGDTVEVMVLEIDEERRRISLGLKQCKANPWTQFADTHNKGDKVTGKIKSITDFGIFIGLEGGIDGLVHLSDISWSISGEEAVRQYKKGDEVSAVVLAVDAVKERISLGIKQLEEDPFNNFVAINKKGAVVSATVVEADAKGAKVELAGGVEGYIRSADLTNEVAVGDVVEAKYTGVDRKSRIVHLSVKAKDQAEEAAAVASVNNKQEDIVIPNAMAEAFKAAKGE

SEQ ID NO: 28096 - protein, 307 aa, Staphylococcus epidermidis
MNAAVRAVTRTAIYNNIEVYGVYQGYQGLLDDDIHKLELGSVGDTIQRGGTFLFSARCPQFKEEDVRKKAIENLRKRGIEGLVVIGGDGSYRGAQRISEECKEIQTIGIPGTIDNDINGTDFTIGFDTALNTIIESVDKIRDTASSHARTFIVEVMGRDCGDLALWAGLSVGAETIVLPEVNTDIKDVAEKIEQGIKRGKKHSIVMVAEGCMSGQECADELTKYINIDTRVSVLGHIQRGGSPSGADRVLASRLGGYAVELLKQGETAKGVGIRNNQLTSTPFDEIFAESDRKFNSQMYELAKELSI

SEQ ID NO: 28097 - protein, 360 aa, Nostoc punctiforme
MGEPKRIGILTSGGDCSGLNAVIRAVVNCAVDTYGWEVLGIRQATLGLMARPPQFTKLEIDQVDSLLTAGGTMLGTTNKGDPFAFPMTDGSLCDRSEEIIAGYHELGLDALIGIGGDGSLAILRRLAQQGGINLVGIPKTIDNDIGVTEHAIGFDTAVNIATEALDRLHFTAASHSRVMILEVMGRDAGHIAIAAGIAGGANVILIPEIPYTVEHICHKIKERQEKGKNYCLIIVSEAVRTHDGENVTITNRLGQSRYGGIGEYLADKIIEHIGVETRVTVLGHIQRGGTASPLDRLVATAFGVAAVNLIAEDKYDRMVTWQNRQVLSVPITEAIAQYSAVDPNGTLVKTAHGMGIYLGD

SEQ ID NO: 28098 - protein, 228 aa, Solanum lycopersicum
MAGPSPPAVSAGAIQSPQAAGLAASSAQMAQHQLAYQHIHQQQQQQLQQQLQTFWANQYQEIEHVTDFKNHSLPLARIKKIMKADEDVRMISAEAPVVFARACEMFILELTLRAWNHTEENKRRTLQKNDIAAAITRTDIFDFLVDIVPREDLKDEVLATIPRGTLPVGGPTEGLPFYYGMPPQSAQPIGAPGMYMGKPVDQALYAQQPRPYMAQPIWPQQQQPPSDS

SEQ ID NO: 28099 - protein, 318 aa, Mannheimia succiniciproducens
MSDIKHSKLLILGSGPAGYTAAIYAARANLNPVLVTGLEQGGQLTTTTEIENWPGDFAETTGPELMQRMLQHAEKFDTEIVFDHINRVDFSSRPFKLYGDVQTFSCDALIIATGASARYLGLPSETEYKGRGVSACATCDGFFYRNKPVAVIGGGNTAVEEALYLANIASEVHLVHRRDAFRAEKILIDRLYKKVEEGKIILHTNRNLDEVLGDNMGVTGVRLKDTQSENTEEIKIDGLFVAIGHAPNTAIFADQLELNNGYIVVKSGLNGNATATSVEGIFAAGDVMDHNYRQAITSAGTGCMAALDAERYLDALEA

SEQ ID NO: 28100 - protein, 104 aa, Clostridium perfringens
MVKHINDQDFNTEVIEVSEVVVVDFWATWCGPCKMIAPVIEELANEMQNVKFVKVDVDKNPGSAGKYQIQSIPTLLIFKDGKVVDTLVGFRPKAALVEAIKKHV

SEQ ID NO: 28101 - protein, 295 aa, Bacillus halodurans
MKTARLIYNPTSGREQIRKSLAYILERLELAGYETSTHATTGEGSATEAARLAGERRHDLVIAAGGDGTIYEVVNGLAGLEKRPTLGLIPAGTTNDFARALNIPRDIEKACDILIEGHTKPVDVGKAGDHYFINIAAGGTLTELTYEVPSKLKTVVGQLAYYIKGLEKLPQISPTDVRIEYDGKLFEGEIMMFLVSNTNSVGGFERLAPNASLRDGMFDFIIVKKTSFPEFLHLAGLALRGEHIKHPKVLYVQANRIKVQAEKSMQLNFDGEYGGLLPAEFVNLYQHFQMLCPKD

SEQ ID NO: 28102 - protein, 999 aa, Unknown
  Malus x domestica
MLLFLPLLLLLLLPPLPTTLSLNQEGLYLRHFKLSLDDPDSALSSWNYADSTPCNWLGVTCDDASSSSPVVRSLDLPSANLAGPFPTVLCRLPNLTHLSLYNNSINSTLPPSLSTCQTLEDLDLAQNLLTGALPATLPDLPNLKYLDLSGNNFSGAIPDSFGRFQKLEVLSLVYNLIENTIPPFLGNISTLKMLNLSYNPFHPGRIPAELGNLTNLEVLRLTECNLVGEIPDSLGRLKNLKDLDLAINGLTGRIPPSLSELTSVVQIELYNNSLTGELPPGMSKLTRLRLLDASMNQLSGQIPDELCRLPLESLNLYENNLEGSVPASIANSPNLYEVRLFRNKLSGELPQNLGKNSPLKWFDVSSNQFTGTIPASLCEKGQMEEILMLHNEFSGEIPARLGECQSLARVRLGHNRLSGEVPVGFWGLPRVYLMELAENELSGPIAKSIARATNLSLLILAKNKFSGPIPEEIGWVENLMEFSGGDNKFSGPLPESIVRLGQLGTLDLHSNEVSGELPVGIQSWTNLNELNLASNQLSGKIPDGIGNLSVLNYLDLSGNRFSGKIPFGLQNMKLNVFNLSYNQLSGELPPLFAKEIYRNSFLGNPGLCGDLDGLCDSRAEVKSQGYIWLLRCMFILSGLVFVVGVVWFYLKYKNFKKVNRTIDKSKWTLMSFHKLGFSEYEILDCLDEDNVIGSGASGKVYKVVLNSGEVVAVKKLWRRKVKECEVEDVEKGWVQDDGFEAEVDTLGKIRHKNIVKLWCCCTARDCKLLVYEYMQNGSLGDLLHSSKGGLLDWPTRFKIALDAAEGLSYLHHDCVPAIVHRDVKSNNILLDGDFGARVADFGVAKEVDATGKGLKSMSIIAGSCGYIAPEYAYTLRVNEKSDIYSFGVVILELVTGRLPVDPEFGEKDLVKWVCTTLDQKGVDNVVDPKLESCYKEEVCKVLNIGLLCTSPLPINRPSMRRVVKLLQEVGTEKHPQAAKKEGKLTPYYYEDTSDHGSVA

SEQ ID NO: 28103 - protein, 759 aa, Ustilago maydis
MPTRTNNRGIPVPRDQARGSVRGDNQQQAAWRSSLDLVWSYSRSQAFYGNNIATSPSFVERRWAGQDLEERDSIFEDEQEYVSGQDDEDESEDYDAHTSHSRFATDADADTDTASMASDARFGPSDQFEWEGEALPPNATQRIRTSRRSKARDRRLEQLESADEDERSRSRSRSPKRLAPGGPHERTSNSKLNPNRSAYSSATTGEMLRDPFAEDNINNNIKPSEVTPLLSNKRSTDANPARRKSATYGALQRPSDSATLSNRSADSGYHVYELGNSTLLQSWFNTVNALVGVGILALPLAFSYAGWIGGTILFLVCGLLTNYTGKVLAKIMSKEPSLRTYADIGSYAFGPSARILISLFFCLELWAVSVALIILFGDSMSAIFPNIAPAAFKLLGYCLVLPSVFLPLKFLSPISVIGIVSTFTLVVVVISDGLIKKHAPGSLWSIAPTTLGPRWDRLPLSFGLIMSGFSSHPIIPSLVRDMKDPAKFPRMLNLAYVGATVLYLSMGMVGYAMFGTQVSDEITKDLARTPGFPVALNSVAIWLIVINPLSKFALATRPIQTTFEILLGIDDQTAVRLQNRNVKARRRSSAAALAATSANVATDGSKIRMDDAAAAANKVVGPVQSRAQAQLTSEANSTTLSVSPNHRVSFATPGAPSSTVPQPEHQPPTSPTTHAAPANDNPLANSAISLRAAELTSTLSPRTRFILSILLKILLTLLIAVTAVVLPGFEKVMGVPRSIPGFCNMCLWSSVGQLEAFRQ

SEQ ID NO: 28104 - protein, 616 aa, Solanum tuberosum
MDGCWLKGPMYRTQLLTAVGIDGNNSIFPIAYAIVEKESLIEAFNEVLPYVNHRFCARHLHNNFKRAGFGGFTLKKAFWAAAKATTVKEFDACMVRIRELDPNAVDWLNDKEPSQWSRSHLSSDAKCDILLNNICEVFNSMIFDARDKPIVTLLEKLRYLLMARMLANREKAHKWSSNDVCPKIKDILHKNQTAAGEYIPRKSNQRKYEIIGATIHDSWAVDLENRICSCTKWSIMGIPCKHAIAAIRAKKDNILDYVDDCYKVETYRRIYEHAILSINGPQMWPKSTKVPPLPLTIVGNKKTGRKQKARRKEADEVGASRTKIKRKQQSLDCSTCNKPGHNKKTCKYNVVSQETTSVHQKLHVRRGLEEAGQEKTRQEGAGQEKTVGQEEVVDIDSEAPNYRKEQKLEIGSKRDRRTVKEFLRTILSLNSKIMDYFKPFFPIQGSCPCHVLSLHPGWDRYSEAIAGPKRTLGLAFLTQRKPNPTELLNENARLTTDSGVLSRINDVLDADPGYLCLHHNKMQANWHQYMECTSMRVGKLNHNLSLKGIQENTYLGPVYDHTFIDDFLTFKRTSECWKQLGNIGTIPRTCMRKCEKNGGTWRPWRGAPALEAQKAG

SEQ ID NO: 28105 - protein, 589 aa, Saccharomyces cerevisiae
MTISSAHPETEPKWWKEATFYQIYPASFKDSNDDGWGDMKGIASKLEYIKELGADAIWISPFYDSPQDDMGYDIANYEKVWPTYGTNEDCFALIEKTHKLGMKFITDLVINHCSSEHEWFKESRSSKTNPKRDWFFWRPPKGYDAEGKPIPPNNWKSYFGGSAWTFDEKTQEFYLRLFCSTQPDLNWENEDCRKAIYESAVGYWLDHGVDGFRIDVGSLYSKVVGLPDAPVVDKNSTWQSSDPYTLNGPRIHEFHQEMNQFIRNRVKDGREIMTVGEMQHASDETKRLYTSASRHELSELFNFSHTDVGTSPLFRYNLVPFELKDWKIALAELFRYINGTDCWSTIYLENHDQPRSITRFGDDSPKNRVISGKLLSVLLSALTGTLYVYQGQELGQINFKNWPVEKYEDVEIRNNYNAIKEEHGENSDEMKKFLEAIALISRDHARTPMQWSREEPNAGFSGPSAKPWFYLNDSFREGINVEDEIKDPNSVLNFWKEALKFRKAHKDITVYGYDFEFIDLDNKKLFSFTKKYNNKTLFAALNFSSDATDFKIPNDDSSFKLEFGNYPKKEVDASSRTLKPWEGRIYISE

SEQ ID NO: 28106 - protein, 77 aa, Acorus calamus
MKEQKLIHEGLITESLPNGMFWVRLDNEDLVLGYISGRIRRSSIRILPGDRVKIEVSRYDSTRGRIIYRLRNKDSNE

SEQ ID NO: 28107 - protein, 250 aa, Oryza sativa
MVDDFISNPDIHKYGCALVRILRSGRKLSFVYPKTRSNLGPVGQKIKGINHALSPKEIISTYCKEVRELGFRLYGAISESLGLEQDYIKKVLGEQEQHMAVNFYPKCPEPELTFGLPAHTDPNALTILLMDQQVAGLQVLKEGRWIAVNPQPNALVINIGDQLQALSNGRYKSVWHRAVVNSDKARMSVASFLCPCNDVLIGPAQKLITDGSPAVYRNYTYDEYYKKFWSRNLDQEHCLELFRTTPTDTS

SEQ ID NO: 28108 - protein, 448 aa, Streptococcus agalactiae
MSKKLISIVDVKDYVGQEVTIGAWVANKSGKGKIAFVQLRDGSAFFQGVAFKPNFIEKYGEESGLEKFDVIKRLNQETSVYVTGIVKEDERSKFGYELDITDLEVIGESHEYPITPKEHGTDFLMDNRHLWLRSRKQMAVMQIRNAIIYSTYEFFDQNGFIKFDSPILSENAAEDSTELFETDYFGKPAFLSQSGQLYLEAGAMALGRVFDFGPVFRAEKSKTRRHLTEFWMMDAEYSFLSHEESLDLQEAYVKALIQGVLDRAPQALDILERDVEALKRYIAEPFKRVSYDDAITLLQEHEADEDTDYEHLEHGDDFGSPHETWISNYFGVPTFVVNYPASFKAFYMKPVPGNPERVLCADLLAPEGYGEIIGGSMREDDYDALVAKMDELGMDKSEYDFYLDLRKYGSVPHGGFGIGIERMVTFVAGTKHIREAIPFPRMLHRIKP

SEQ ID NO: 28109 - protein, 542 aa, Mycobacterium avium
MRMTEADTPFDVLVIGAGFSGLYMLHRLRQLGIPARVLEMAENVRGTWLFNRYPGARCDIESIEYSYSFSEEIQQEWVWTESMPAQPEILAYLNYVADRLDLRRDIQFGAEVVAMTFDEDAAMWSVRTRSGDTFRVPFVVAASGILSVPLQPDIPGMNTFAGTSLFTSRWPAAGVDLTGKRVGVIGTGSTGVQLIPVVAREALHLSVFQRSPAYTLPWRVHRFQPGELDEMKARYGEIRAAQRAHPIGAARLSAFSVLLEMLGRPPLKSATPEERLRAIEEHGVLGALNWGDVFFDIEANRMAAELYGEAVARIVKDPETAASLVPVHPFACKRPIIDQGYYETFNRDNVTLVDLRKSPIREVTPAGIRTEDRLHELDVIVYATGFDAMTGALSRIDIRGRGGIGLAEFWATQGPLSYLGLAVAGFPNLFTVQGPGSPSAATNFVAALEQHVEWIGDCIGYLRANHIRTIEALSTAQQEWIEHTTALVAPTVLVHPSCNSWYNGGNVPGKKRMYMGYTGGIPEYRRRCDEIAAGGYTGFKLA

SEQ ID NO: 28110 - protein, 469 aa, Ostreococcus tauri
MGVSNERGLIVSWDDDVTVDERARATEAVAHAVAHGCVIGDRENVGGYAHAPVSCAPTVFPRRAYELARAVSPRFAELYDAVSRDDAFMRNALKGAIKNDAFTAALWRVYEESGGQAGRPRAEVGVLRSDYMLDAPSGLPLQVEVNTVSTSFMALATKVSAMHRHLARWSAKGGEAVDLSGVPENEALQCAGDILAAGWKAGGSKGKIMMVVQPHERNMFDQRHISQYIFEKYGVHTVRATLAEINAEGELRDETLTFQGDDIGLVYFRAGYTPTDYPTDGEWAARLMIEKSNALKSPSAAMHLAGSKKIQQKLAEPGVLETFMPEHAEEMRRVFAGLYSLDGEDAIKTVELALSNPAGFVLKPQREGGGNNLYSDELRARLEQGGDLSEYILMQRILPPAHQTLTVREGDVKKIETLSELGIYGSYLRVGDEVVINKHGGHLLRTKAASSDEGGVAAGYAVLDSPLLV

SEQ ID NO: 28111 - protein, 318 aa, Prochlorococcus marinus
MEIIETDVAIIGGGPAGCTCALYTSRSNLNTVIIDKNPSVGALAITHQIANYPGVPVDISGEKLLTLMREQAVQYGTDYRRAQVFGIDVAEDWKTVYTPEGTFKAKALVLASGAMGRPASFKGEADFLGKGVSYCATCDGAFYKNREVAVVGANKEAIEEATVLTKFASTVHWITSSDPKSDNEEAMELMHSSNIKHWSRTRLLEIKGNDMGVNGVVVKNKQEEGPINLDLDGVFVYMSGSKPITDFLGDQIALKEDGGVIVDDFMSTNSDGVWAIGDIRNTPFKQAVVAASDGCIAAMSIDRYLNSRKNIRVDWIHS

SEQ ID NO: 28112 - protein, 508 aa, Coffea canephora
MALLLILLPVAFIFLAYSLYERLRFKLPPGPRPKPVVGNIYDIKPVRFKCYAEWSKLYGPIFSVYFGSQLNTVVDTAELAKEVLKDNDQQLADRYRSRPSARMSRNGQDLIWADYGPHYVKVRKLCNLELFTPKRLEGLRPLREDEVTAMVDSIFKDCTIPENKGKSLLMRNYLGSVAFNNITRLTFGKRFMNSEGVVDEQGQEFKGIVSNGIRIGAKLSVADHIPWLRWMFVGENEDLDKHNARRDKLTRMIMEEHTLARQKSGNTKQHFVDALITLQKQYELSDDTVIGLLWDMITAGMDTTTISVEWAMAELVKNPRVQHKAQEELDRVIGSDRIMTEADFAKLPYLQCVAKEALRLHPPTPLMLPHRANANVKIGGYDIPKGSIVHVNVWAIARDPAAWKNPLEFRPERFLEEDVDIKGHDYRLLPFGAGRRICPGAQLALNLVTSMLGHLLHHFTWSPPTGVSPEEIDLEESPGTVTYMRTPLQAVATPRLPAHLYNRVPVEL

SEQ ID NO: 28113 - protein, 251 aa, Synechococcus elongatus
MAIISLAEMMESGVHFGHQTRRWNPRMAPYIYTARNGVHIIDLVKTAQCVETAYRWVRTNAEQGKRFLFVGTKRQAAGIIAEEATRCGSYYINQRWLGGMLTNWATIKGRVDRLKELERMGETGALALRPKKEAAVLRRELERLQKYLGGIKNMRRLPDAVVIIDQKREYNAVQECQKLGIPIVAMLDTNCDPDVVDVPIPGNDDAIRSVKLIVSKLADAIYEARHGAAPVAEEYDYDGAEDEYEDDADEA

SEQ ID NO: 28114 - protein, 508 aa, Coffea canephora
MALFLLLLTFIFILPPYYLYQKLRFKLPPGPRPLPVVGNLYDIKPVRFRCFADWSRAYGPIISVWFGSTLNVVVSNAELAKEVLKENDQQLSDRHRSRSAAKFSREGQDLIWADYGPHYVKVRKVCTLELFSPKRLEALKPIREDEVTAMVESIYKDCTLREGSGQSLLVKKYLGTVAFNNITRLAFGKRFVNSEGVMDEQGKEFKEITANGLKLGASLAMAEHIPWLRWLFPLDEAAFAKHGARRDRLTRAIMEEHRLAREKSGGAKQHFVDALLTLKDKYDLSEDTIIGLLWDMITAGMDTTAISVEWAMAEVIKNPRVQQKVQEELDQVIGYERVMIETDFSNLPYLQSVAKESLRLHPPTPLMLPHRSNASVKIGGYDIPKGSNVHVNVWAVARDPAVWRNPLEFRPERFLEEDVDMKGHDFRLLPFGAGRRVCPGAQLGINLVTSMLGHLLHHFNWAPPHGLSPDEIDMGESPGLVTYMRTALRAVPTPRLPSHLYERVAVDM

SEQ ID NO: 28115 - protein, 826 aa, Zea mays
MEDVLTPPQPELAGEKPLRMRPAATSPGTRCGRRACAPSSAAAAPAPKGAVTGTPAATRTPRRSSAHGPDGTWDPTSDRAKELRKVAAEAQEEAEEEVTVDEQSLDKCLVGLPRGWTADRLKSLLQDQAISTNAQLILVLGFIGQCLGISYATAKKKKGMTVGFVTFQSVEQLTNAVQVLKENPSGGKQIKIVDANRRSHQKAHAGAPVSNTGTATENGSSPTTPAEETSVPESVSSSKKGARDAVTPLAHMTYIDQLEHKKQSMAQILKKLTRNARKACPPTIPHPDWVFKSKEIGAALQSLTGAPRLLAAIANDDILPVLNYFKVSEGSEPHAATLFTAFICICCVVIGNLDLITPTITMFFLLCYAGVNLSCFLLDLLDAPSWRPRWKFHHWSLSLVGALFCVVIMFLISWSFTVVSLALASLIYYYVSIKGKAGDWGDGFKSAYFQLALRSLRSLGANQVHPKNWYPIPLIFCRPWGKLPENVPCHPKLADFANCMKKKGRGMSIFVSIIDGDYHELAEDAKTACRQLDAYIDYKRCEGVAEIIVAPTMSDGFRSIVQTMGLGNLKPNIVVMRYPEIWRRENLTQIPSTFVSIINDCIIANKAVVIVKGLDEWPNEYQRQYGTIDLYWIVRDGGLMLLLSQLLLTKESFESCKIQVFCISEEDTDAEELKADVKKFLYDLRMQAEVIVVTMKSWESHMESSSSGVQQDNSHEAYTSAQQRIETYLDEMKETAQRERQPLKENGRQVVVNEQKVDKFLYTMLKLNSTILRYSRMAAVVLVSLPPPPLNHPAYFYMEYMDLLVENVPRMLIVRGYTRDVVTFFT

SEQ ID NO: 28116 - protein, 181 aa, Moorella thermoacetica
MHEDIAEVLVSAADIQKRVKEMGAAISRDYAGKDLLVVGILKGAIIFLADLVREITIPLQLDFMAVSSYGSGTSTSGAVRILKDLEVPVEDKHLLIVEDIIDTGLTLKYLLENLKARQPLSVKACTILDKPERRLVDVHVDYSGFCIPDYFVVGYGLDYAQKYRHLPDICVLKPEVYRRKK

SEQ ID NO: 28117 - protein, 167 aa, Saccharomyces cerevisiae
  misc_feature (1)..(1): Xaa can be any naturally occurring amino acid
XESCKMFIGGLNWDTTEDNLREYFGKYGTVTDLKIMKDPATGRSRGFGFLSFEKPSSVDEVVKTQHILDGKVIDPKRAIPRDEQDKTGKIFVGGIGPDVRPKEFEEFFSQWGTIIDAQLMLDKDTGQSRGFGFVTYDSADAVDRVCQNKFIDFKDRKIEIKRAEPRH

SEQ ID NO: 28118 - protein, 77 aa, Vitis vinifera
MKEQKWIHEGLITESLPNGMFRVRLDNENMILGYVSGRIRRSFIRILPGDRVKIEVSRYDSTKGRIIYRIRNKDSNN

SEQ ID NO: 28119 - protein, 947 aa, Methylococcus capsulatus
MALLKDKDFGTPPSTSDKMVTLEIDGFTATVPEGTSVMRAAASIGIDIPRLCATDSLEPFGSCRLCVVQIEGGRGLPASCTTPVFEGMKVVTQNDRLAQIRRGIMELYISDHPLDCLTCSANGNCELQDMAGVVGLREVRYGYEGANHFDAKKDLSNPYFQFEPSKCIVCSRCVRACEQTQGTFALTIDGRGFDSKISPGQNQAFMDSECVSCGACVQACPTATLIEKSVVEKGQADHSIITTCAYCGVGCSFKAEMKGSEVVRMVPDKNGQANHGHSCVKGRFAFGYATHPDRITSPMIRKSIHDPWQKVSWEEAINYAASEFKRIQAKYGKDSVGGLTSSRCTNEEAYLVQKLVRAAFGNNNVDTCARVCHSPTGYGLKQTLGESAGTQTFDSVMKSDVIMVIGANPTDGHPVFGSLMKKRVRQGARLIVVDPRDIDMVRSPHIEADYHLKLKPGTNVAVVNALAHVIVREGLVDEAFVNARCEAESFSKWKDFVAQERNSPEAMESVTGVPAQTLREAARLYATGGNAAIYYGLGVTEHSQGSTTVIAIANLAMATGNVGREGVGVNPLRGQNNVQGSCDMGSFPHELPGYRHVSDSTVRAQFEAAWNTRLDPEPGLRIPNMFAAALEGSFKGLYCEGEDIAQSDPDTQHVFAALEAMECVVVQDLFLNETAKFAHVFLPGASFLEKSGTFTNAERRISPVRRVMPPLAGYEDWQVTQMLANALGYPMNYSHASEILDEIASLVPTFSKVSFKRLDEVGSLQWPCNEEAPNGTPTMHVDHFVRGKGRFMLTEYVPTEERTSSKFPLILTTGRILSQYNVGAQTRRTANTAWHSEDRLEIHPHDAENRGIKDGDWVGIKSRQGETVLRAVVSERMQPGVVYTTFHFPESGANVITTDNSDWATNCPEYKVTAVQVTKVNAPSEWQQKFRSFTEEQLSFLEKATAG

SEQ ID NO: 28120 - protein, 984 aa, Staphylococcus aureus
MQEHLVVTLDGKDYLVEPGTNLLEFIKSQDTFVPSICYNESMGPIQTCDTCTVEIDGKIERSCSTVIDRPMTVNTVNNDVKDAQKEALDRILEKHMLYCTVCDYNNGDCEIHNTMDAWGLQHQTYEYKEKPYEKDYGPFYRYDPNQCILCGRCVEACQDIELNETIRIDWDREHPRVIWDNDVPINESSCVSCGQCATVCPCNAMMEVNMEGNAGYMTDTEPGSLAAMIDLTKKAEPGYGPLFAISDSEAEMRKERIKKTKTVCTYCGVGCSFEVWTKDREILKVQPSHDSPANKIATCVKGKFSWGHINSDQRLTKPLVRKNGEFHEVEWDEALNVIADNFTSIKEKHGPDALSFISSSKATNEESYLMQKLARQVIGTNNVDNCSRYCQAPATKGLFRTVGHGGDSGSIEDLEKAAMSVLIGTNTAEAHPVIASRMKRAQKLFGQKIHVFDIRKHEMAERADRFYQPKPGTDLAWLSAVTKYIIDHDLHDKAFIEEWVEDFDEYYKSLETFTMAFAEEATGIPEAELIKFAEECAKAESVVICWAMGITQQDIGSDSSTAISNLLLVTGNYRRPGTGAYPLRGHNNVQGCSDIGSMPDKITGYQSIEADDIRAKFEKEYGVKLNPKAGKDNHEMVEGIHDGQIHSLYLYGEDTGIVDSNINFVQAAFEKLDFMVVQDEFLTFTATYADVVLPASPSLEKDGTFTNTERRIQRLYQALKPLGDSKPDWKIFQAIANKLSFDWNYKHPSEIMDEIARLTPLYAGVSYERLEGFNSLQWPVHPDGTDEPILYLEGFNFDNGKAKLFPLSFDNYFKQDEVYDIHVNNGRLLEHFHEGNMTYQTPMLKYKVPRAFVEISPELAEDRGIHEGAEVKLISETGEAVLQVHVTDRVKGKEIYIPLNNDAMENGDLGAINLLTNSDVDQYTDTPSYKRTSCRMEVITKRGKSPLNPNNFRVNKKRHPQYSVQVQKKWERPDYVFPGNQVDK

SEQ ID NO: 28121 - protein, 124 aa, Phaseolus lunatus
EPPTEGRLPDATKGSDHLRDVFGKAMGLSDLDIVALSGGHTIGAAHKERSGFEGPWTSNPLIFDNSYFKELLSGEKEGLLQLPSDKALLTDPVFRPLVEKYAADEDAFFADYAVSHQKLSELGF

SEQ ID NO: 28122 - protein, 203 aa, Cucumis sativus
VLTGDSGVGKSNLLSRFSKNEFRFDSRPTIGVEFAYRNIKVADKLVKTQIWDTAGQERFRAITSSYYRGALGALLVYDITRVATFDNIKKWLRELREFGNPEMVIILVGNKCDLHQSREVQEEEARHLAELENLFFMETSAKDNLNVEEAFLEMVRRIHAIASQKTLDLHKKFEKLVAFPNGKEIISIHEVTPTKPNSNCCSL

SEQ ID NO: 28123 - protein, 269 aa, Medicago truncatula
AVIIVVVQGEERNMYDQHFVSAILREKHHITTIRKTLAEINQEGEILPDGTLSVDGQAVAIVYFRAGYTPVDYPSESEWRARLLIEQSSAIKCPNISYHLVGTKKIQQELARPNVLERFFENKEDIAKLRKCFAGLWSLEDSDIVNEAIAKPELFVMKPQREGGGNNIYGDDLRETLKRLQKPGSQEDAAYILMQRIFPANTASILMRNGFLHKDHVISEFGIFSTYLRNKDKVIVNNESGYMVRTKPSLSDEGGVLPGFGVIDSVFLT

SEQ ID NO: 28124 - protein, 107 aa, Phaseolus lunatus
NEINLGDYKGRVLIIVNVASQCGLTNSNCTELSQLYEKYKQKGLEILAFPCNQFGAQEPGSNEQIQEFVCTRFKAEFPVFDKVDVNGDKADPLYKYLKSSKGGLFGD

SEQ ID NO: 28125 - protein, 556 aa, Medicago truncatula
MAASAFGFGGIRFSKTIPLSKYIPPLQPHHNNTFFSFFPSSSSSSSSSSSSSINFSTKPLPMSHHKHLTINGDEQNIIKPSPLFVDDYHNIDQQLLDNIAYDALVWASLHGLLMGDKSYQKSGMVPGVGLMHAPFSLFPTSFPESKWKQACDLAPIFNELVDRVSLDGKFLQESLPRTKQVDEFTSRLLDIHSKMLQLNKKEEIRFGLHRSDYMLDEQTKSLLQIELNTISSSFAGFSTLVTQLHRYILTCHGKLLGLDSEKVPANNAVSQNAEALAKAWSEYNNPRAVIMTVVQAEERNMYDQHFLSAVLRDKHGITIVRKTMAEVDQEGEILPDGTLSVNGQAVAVIYFRAGYTPVDYPSESEWRARLLMEQSSAVKCPSISYHLVGTKKIQQELAKPGVLERFLENKDDIAKMRECFAGLWSLDDSDIVKKAIERPELFVMKPQREGGGNNIYGDAVRDTLIKLQKTGSQEDAAYILMQRIFPNISAAVLMRNGGCHKDHAISELGIFGTYLRNKDRVVMNNQSGYLMRTKISSSDEGGVAAGFAVIDSVYLT

SEQ ID NO: 28126 - protein, 138 aa, Brassica napus
MQGALCIKPTVLPLSSPKLTLLPPQTISTTKPSRLSSLRFRPNSSSPSTSDPLTVDYNDSPLSVFPAEACEVISGYACSADIYPEVKLETKPVSPPVASEPVDREYLEYNNPKTVFPAEACDDLGGEFCEPDYQKDVY

SEQ ID NO: 28127 - protein, 389 aa, Oryza sativa
SFFQWRWRRRRRQEEFYLQGSHQVCVSAWHRWTGRFEAHLWDKNCSTSLQNKKKGRQVYLGAYDSEEAAARAYDLAALKYWGPETVLNFPLEEYEKERSEMEGVSREEYLASLRRRSSGFSRGVSKYRGVARHHHNGRWEARIGRVLGNKYLYLGTFDTQEEAAKAYDLAAIEYRGANAVTNFDISCYLDQPQLLAQLQQEPQLLAQLQQELQVVPALHEEPQDDDRSENAVQELSSSEANTSSDNNEPLAADDSAECMNEPLPIVDGIEESLWSPCLDYELDTMPGAYFSNSMNFSEWFNDEAFEGGMEYLFEGCSSITEGGNSMDNSGVTEYNLFEECNMLEKDISDFLDKDISDFLDKDISISDRERISPQANNISCPQKMISVCN

SEQ ID NO: 28128 - protein, 1388 aa, Magnaporthe grisea
MVSRDASIAGEAACETNPLGPLKHSEYENGRSGPDTGSFYSSKTSATEQYQPTPESIFASQHDDQINLSSSMLGFNNGSGDDIPPPRSPLTLSLPLKTVVLANEAMGRLLGFDADGPTAMTVQERLKGRTISQVGIDLLQDGKVARLKWDNFLDLVADNVSLGPTFRPTEGADGSSTPTWASENSDAKQPPRPQTCVDVIISKDDVGKPKATWPHRVSKSNPELYTYAKMLISVWEVDGQMYFTLTFTNTESKVDASARHKKSVAQPSLIEDAKSRSVYATHSSSTGTSSIESPTSSHSSLITPVSLGLSPFPPFGPPNSSTNQNGPSILTKLLTMKDATLDNSQMPILAMWKDGSASFPNKAARAMFRTDQSDASEGDALLRRWDVYDEDFTQALEPQDYPISILLRTETPFTGIRIGMYNPDGQKVVFDVLGEAIKDEQTGEFLAGVIYCRDVSPMKQIINNMKELEDEKFRLICDTMPQLVWTTTPDGRHDFYNDRWYRYTGLTKGDSLGLGWKHPFHPDDMPEAERRWARSLATGQPYDVEYRCRNKDGEWRWMLGRALPLRDPETKEIKKWFGTCTDVHESIQAKVTAERLREQLLTVITHAHVTIFTVDNDRNVTMLEGALRWDATGENYRDLEGDSKWYVGRNMYEVFNTLNSHLEDGERPRFLEPIEAILAGKSTEDIQEHGFDGRWYRTRFIPVSAKLKTAEGFSNNAGSIEGVIGVIFDVTELRAREMDLVEQAKERRQLVANEAAAKEASRLKSQFLANMSHEIRTPITGVIGMSELLLDLELGDEEREYGENIYRSANALLAVINDILDFSKVESGHLDIEEVQFSLSVIVGDVNKMLSFAAERKNLDFQSEIASDIEEDLVVLGDPGRVRQIITNLLTNSIKFTKQGYVRFSVVKERETPDIIEIKFVVEDTGIGIDAQVRSRLFQPFSQGDASTARRFGGTGLGLTISKNLLELMKGRMTLESAEGKGTTATFWIPFNRPPNGSYEGNLVQIDALPDRLQSDISVSCNSLGESEQISTAATKGQADSRASTPSGNKSASSLRRKPSIALGPASPVLADLSMADRAEMHVLLVEDNLIIQQIAIKNIKKLGFKVDAVWNGKEALAYLEGAQDGKNPKPDIILMDVQMPVLDGYRTVHLLRHHFPYKTYVNDVPIVAMTASAIQGDRERCMQAGMDDYLAKPVKSKLLEKMLVRWTKDRRKLPEMTAGLSCSSSECGVSDGSLGTMESPALPPIMSDIADSLLLRRPKQHQQPAVLPVPENINEDNGNGGEMPDSSTPMPIQEGPQSSGFRLLSNESEGAKFQKPLRIMEASERAMHSRDDKLVNAAEDEFSRPSPSYSLEAPLGMGSGFLTEENMGRLGLQEALKQQRSSGPGEG

SEQ ID NO: 28129 - protein, 459 aa, Photorhabdus luminescens
MAGQSQRSTLKRGLKNRHIQLIALGGSVGTGLFLGIAQTIKMAGPSVILGYAIAGFIAFLIMRQLGEMVVEEPVAGSFSHFAYKYWGDFPGFLSGWNYWAMFTLVGMAELTAVGMYIHYWWPDIPTWVSATIFFVLINTVNLINVRLYGETEFWFSIIKVTAIICMIVFGSYLLVSGNGGPQASITNLWQHGGFMPNGISSLIMAMAVIMFSFGGLELVGITAAEAENPRISIPKATNQVVYRILIFYIGSLTVLLSLYPWGNVVEGESPFVMIFHNLDSFWVANILNIVVLTAALSVYNSGVYCNSRMLYGLAKQGNAPEMLTKVNESGVPIRAIVMSALATSIGVLINYVMPGKAFELLMALVVTTLVINWVMICMAHLKFRAEKVKQGIAPSFKAFWYPFGNYLCLVFLAFILVIILMMDSIRISVILMPFWVGVLWLGFLMSHSRRDKMKTEELG

SEQ ID NO: 28130 - protein, 257 aa, Bacillus subtilis
MGKVYIVGAGPGDPDLLTIKALKAIEKADVILYDRLVNKEILQYAKEQADLIYCGKLPDFHTMKQETINRFLVKYAQKGKMVVRLKGGDPFVFGRGGEEAECLSENGIPFEIIPGITSGIAAAAYAGIPVTHRDAGSNVAFVTGHYKKEEDFEEKWKALATGIDTLVIYMGIKNVQQIERKLLENGRDGSTPAAFIHWGTTDKQKSVFCTVDTLSETVIKENITNPSLIVIGNVVNYHYKLEWFESELKKQDLSEAL

SEQ ID NO: 28131 - protein, 539 aa, Methanocaldococcus jannaschii
MFCFQCQEAAKNEGCTIKGVCGKDDVVANLQDLLIYTIKGLCYVCDKGNYLDDEVMDYIPKALFVTITNVNFDDKDVINWIKKGVALREKIIEKNNLNKEELPYCATWAYETDEDLINLANTKEVSVLAEDNEDIRSLKELITYGIKGIGAYLSHAMHLGYNNEDIHKFIIKAFTKIVDSKDADELFNLAMETGKYAVETLALLDKANTETYGHPEITEVNLGVRDRPGILISGHDLKDLEQLLEQSKDAGVDIYTHCEMLPAHYYPFFKKYEHFVGNYGGSWPFQREEFEKFNGPIVMTTNCLVPPKDSYKDRVYVTNEVGYPGLKRIPVKEDGTKDFSEVIEHAKKCKPPTPLENGKIVGGFAHNQVLALADKVIEAVKSGKIRKFVVMAGCDGRHKTREYYTEFAKKLPKDTVILTCGCAKYRFIKLDLGDIDGIPRVLDAGQCNDSYSLVKIALALKDAFGLNDVNELPIAYNISWYEQKAVTVLLALLYLGVKNIVLGPTLPAFLSPNVTKVLVEKFGISTISTVDEDIKRLVG

SEQ ID NO: 28132 - protein, 228 aa, Arabidopsis thaliana
MNALAATNRNFRHASRILGLDSKIERSLMIPFREIKVECTIPKDDGTLVSYIGFRVQHDNARGPMKGGIRYHPEVDPDEVNALAQLMTWKTAVADIPYGGAKGGIGCSPRDLSLSELERLTRVFTQKIHDLIGIHTDVPAPDMGTNAQTMAWILDEYSKFHGHSPAVVTGKPIDLGGSLGREAATGRGVVFATEALLAEYGKSIQGLTFVIQVKPLSANLRSQALLCI

SEQ ID NO: 28133 - protein, 208 aa, Mannheimia succiniciproducens
MGKKRSASSSRWLNEHFKDPFVQKAHKQKLRSRAYFKLDEIQQSDRLFKPGMTVVDLGAAPGGWSQYVVTQIGDKGRIIACDILDMDPIVGVDFLQGDFRDENVLAALLDRVGEDQVDVVMSDMAPNFSGMPSVDIPRAMYLVELALDMCKQVLAKKGSFVVKVFQGEGFDEYLREIRSLFTTVKVRKPEASRDRSREVYIVATGYRG

SEQ ID NO: 28134 - protein, 478 aa, Oryza sativa
MAERIAASLLPAASPSPAPSPPPPRPRVSAAAAASFPCCSTSAGGLRLRSRPSRFPQKAATTRSGRAGAGARAVVRCMAAAAVAASDAAQLKSAREDIREILKTTYCHPIMVRLGWHDSGTYDKNIEEWPQRGGADGSLRFDAELSHGANAGLINALKLIQPIKDKYPGITYADLFQLASATAIEEAGGPKIPMKYGRVDVTAAEQCPPEGRLPDAGPRVPADHLREVFYRMGLDDKEIVALSGAHTLGRSRPDRSGWGKPETKYTKDGPGEPGGQSWTVEWLKFDNSYFKDIKEQRDQDLLVLPTDAALFEDPSFKVYAEKYAEDQEAFFKDYAEAHAKLSDLGAKFDPPEGFSLDDEPAVEEKDPEPAPAPAAAPPPPPVEEKKEAEPTPVPVTVGAAVASSPADDNNGAAPQPEPFVAAKYSYGKKELSDSMKQKIRAEYEGFGGSPDKPLQSNYFLNIMLLIGGLAFLTSLLGS

SEQ ID NO: 28135 - protein, 201 aa, Xanthomonas oryzae
MGDEVHLTVDEVTYQAHGHAHLGSASGFLAALAEGDIAPVYIEPNARFRVPADADRDILMIGPGTGVAPFRGFVQERAETGANGRNWLFFGAQHFNTDFLYQAEWQLALQRGELHALEVAFSRDQAEKLYVQHRLRARGAEVYAWLQGGAHVYVCGATSMGKDVHAALLDIVASHGALDAEAASAYLTQLQVEGRYARDVY

SEQ ID NO: 28136 - protein, 264 aa, Eucalyptus globulus
HFHDCFVKGCDASLLLDSSGTIISEKRSVPNTNSARGFEVLDEIKSALEKECPQTVSCADLLALAARDSTVLTGGPSWVVPLGRRDSTGASLSGSNNNIPAPNNTFQTILTKFKLKGLDIVDLVALSGSHTIGNARCTTFRQRLYNQTGNGQPDFTLDQSYAAQLRTRCPRSGGDQNLFFLDFVSPIKFDNSYFKNLLAKKGLLSSDEVLVTQSQATLQLVKQYAGNQELFFEQFAKSMVKMGNITPLTGSKGQIRKRCRQVNK

SEQ ID NO: 28137 - protein, 282 aa, Picea glauca
MEHMNTTAQSSSSLYGVHMVEYGGDVGVGSMMALMTEHQPESESIMTSIPIPSSYSSYSHGHGHGHGHGHGQSECLLSAAAMFQTSRPCQGANKFEPANAHIGGGGAGHFVMEQFIPEQAVISDSSISSVKTEVCSGSGGTGVPGQFELIRRKEEGRCARAYAEPSFVVTPLVTSLPPQQQEARMVTSLAVDMDSSCSCKPIEADAMKAKIIAHVHYPRLVAAYIDCQKVGAPPDVVSELDELSQKCHAQQCVATISIGADPELDQFMEAYCEMFIKYQEEL

SEQ ID NO: 28138 - protein, 770 aa, Synechococcus elongatus
MQEAKVAAILGAGAWGTTLAQLLRSNGLEVRQWSRRSETSLAATLAEADLWIMAVSMAGLASVADQVAALQLGDRAIWVSATKGLADLGWRTPSQVLSDRFPLQPITVLSGPNLSKEISQGLPAATVIASRDRHAAAVVQQAFASDRFRVYTNRDPLGTELGGALKNVIAIAVGVCDGLCLGANARSALVTRALAEILRVGAYFGARTETFFGLSGLGDLLATCTSPLSRNYQVGFRLAQGESLAAALTAIAATAEGVSTARVLAQLASREGLELPIAACVAELLDNRISPTTAIERLMARDLKAELVRENQNVASNTLPLAIAEPLAMKKTYVLDTNVLLHDPMALFRFEDNDLVIPITVIEEIDRFKKDLNERGRNARQISRLLDGFRSKGHLIEGITLDHGGKLRVVMLEKTFLEQLPSGLIANANDNAILAVALALQQQNGQPTILVTKDTNLRIKADATGLCAEDYESDKIDFSELYSGTAEVYLAPDQLQVFRREGGLDLSGEFFPNQALTLVDETNLSHTLLGRYRASDRRVVPLIQPPKMGISRIHARNREQQFALDLLLDDNIQLVTLVGKAGTGKTLLAVAAGLHKVADERHFSRLLVSRPIFPMGRDLGFLPGDLQEKLAPWMQPIIDNLDFILGGANNNGDRPSNKQQNYQDLMGMNLLQIEPLTYIRGRSIPRQFMIVDEAQNLTPHEIKTILTRAGEGTKIVLTGDAYQIDNPYVDASSNGLTYVVEKFKNEAIAGHITLERGERSPLAELSANLL

SEQ ID NO: 28139 - protein, 380 aa, Unknown
  Photobacterium sp. SKA34
MSKRDLYEVLGVARDAGERDIKKAYKRLAMKFHPDRNQGDDESAEKFKEVKYAYEILTDGQKRAAYDQYGHAAFEQGGMGGGGGGFGGGADFSDIFGDVFGDIFGGGGGRRQQRAQRGSDLRYNMELTLEEAVRGCSKEIRVPTLVGCDSCDGSGAKKGSSATTCGTCHGAGQVQMRQGFFAVQQTCPHCHGRGQIIKDPCNKCHGEGRVEETKTLSVKIPAGVDTGDRIRLTGEGEAGEFGAPAGDLYVQVHVKEHNIFQRDGNNLHCEVPVSFTMAALGGEVEVPTLDGRVSLKVPAEMQTGRMFRMRGKGVDSVRGGMTGDLICKLVVETPVNLSSRQKELLQELEETFGGKAASKHKPKSEGFFKGVKKFFDDLTN

SEQ ID NO: 28140 - protein, 1252 aa, Streptococcus agalactiae
MKRKDLFGDKQTQYTIRKLSVGVASVATGVCIFLHSPQVFAEEVSASPANTAIAESNINQVDNQQSTNLKDDINSNSETVVTPSDMPDTKQLVSDETDTQKGVTEPDKATSLLEENKGPVSDKNTLDLKVAPSTLQNTPDKTSQAIGAPSPTLKVANQAPRIENGYFRLHLKELPQGHPVESTGLWIWGDVDQPSSNWPNGAIPMTDAKKDDYGYYVDFKLSEKQRKQISFLINNKAGTNLSGDHHIPLLRPEMNQVWIDEKYGTHTYQPLKEGYVRINYLSSSSNYDHLSAWLFKDVATPSTTWPDGSNFVNQGLYGRYIDVSLKTNAKEIGFLILDESKTGDAVKVQPNDYVFRDLANHNQIFVKDKDPKVYNNPYYIDQVQLKDAQQIDLTSIQASFTTLDGVDKTEILKELKVTDKNQNAIQISDITLDTSKSLLIIKGDFNPKQGHFNISYNGNNVMTRQSWEFKDQLYAYSGNLGAVLNQDGSKVEASLWSPSADSVTMIIYDKDNQNRVVATTPLMKNNKGVWQTILDTKLGIKNYTGYYYLYEIKRGKDKVKILDPYAKSLAEWDSNTVNDDIKTAKAAFVNPSQLGPQNLSFAKIANFKGRQDAVIYEAHVRDFTSDRSLDGKLKNQFGTFAAFSEKLDYLQKLGVTHIQLLPVLSYFYVNEMDKSRSTAYTSSDNNYNWGYDPQSYFALSGMYSEKPKDPSARIAELKQLIHDIHKRGMGVILDVVYNHTAKTYLFEDIEPNYYHFMNEDGSPRESFGGGRLGTTHAMSRRVLVDSIKYLTSEFKVDGFRFDMMGDHDAAAIELAYKEAKAINPNMIMIGEGWRTFQGDQGQPVKPADQDWMKSTDTVGVFSDDIRNSLKSGFPNEGTPAFITGGPQSLQGIFKNIKAQPGNFEADSPGDVVQYIAAHDNLTLHDVIAKSINKDPKVAEEEIHRRLRLGNVMILTSQGTAFIHSGQEYGRTKRLLNPDYMTKVSDDKLPNKATLIEAVKEYPYFIHDSYDSSDAINHFDWAAATDNNKHPISTKTQAYTAGLITLRRSTDAFRKLSKAEIDREVSLITEVGQGDIKEKDLVIAYQTIDSKGDIYAVFVNADSKARNVLLGEKYKHLLKGQVIVDADQAGIKPISTPRGVHFEKDSLLIDPLTAIVIKVGKVAPSPKEELQADYPKTQSFKESKTVEKVNRIANKTSITPVVSKKADSYLTNEANLPKTGDKSSKILSVVGISILASLLALVGLSLKRNRHLK

SEQ ID NO: 28141 - protein, 418 aa, Unknown
  Rhodococcus sp. RHA1
MATAEQTFVIVGAGLAGAKAAEALRTGGFDGRIVLIGDETDRPYDRPPLSKAYLQGTTAREKIYIHPAGWYTDHDIELRVGTPVTALDRTEHEVVIDGVERLGYDKLLLTTGSSPRRLQVPGADLDGVHYLRRVTDCETMKAAFAAADRVAIVGAGWIGLETAAAARAAGCAVTVVGRSKLPLLAVLGAEVAETYAALHRDHGVELRLNSGVREIVGKDNRATGIRLTDGTVVEADAIVVGVGIVPNTALAETAGLAVDNGIVVDEHLATTDPDVFAAGDVANTFYPLLGTHLRLEHWSAALNQGPVAAENMIGRVTAYDQVPYFFSDQYDSGMEYSGYVPHGSYDSVVFRGDVAAGEFIAFWMRDGRVLAGMNVNTWGVTDAIEALVRSGERVDPAKLADPDELLRYLADRVPGGAR

SEQ ID NO: 28142 - protein, 710 aa, Bacillus clausii
MDQERHEFSIDWAGRTLSVEVGQLAKQANGAVLVRYGDTAVLSTATASKEPKDLPFFPLTVNYEERLYAAGKIPGGFIKREGRPSERAILTSRLIDRPIRPLFPDGFRNDVQVISIVMSSDQDASPEMAAMIGSSLALCVSDIPFEGPIAGVTVGRINGEFIMNPTPAQLAESDIDLTVAGTKEAINMVEAGAKEVPEDVMLEAILAGHENIKKMIAFQEKVVEVCGKEKREVQLKTFDAELEARLRESAEASIKEAVRIAEKHARQDAIDEIIAAQVEQHSDDDSINVDEVKEILQMFVKEEVRRLITVEKIRPDGRGVDEIRPLSSQIKLLPRTHGSGLFTRGQTQALSVCTLGALGDVQVLDGLGIEETKRFMHHYNFPQFSVGETGPIRAPGRREIGHGALGERALEQVIPSEQEFPYTIRLVSEVLESNGSTSQASICASTLAMMDAGVPIKAPVAGIAMGLVKQGEHMTVLTDIQGMEDALGDMDFKVAGTANGVTALQMDIKISGINREVLEQALEQAKQGRMKILSNMMEAIDKPRAELSEYAPKILTLTINPDKIRDVIGPSGKVINKIIEETGVKIDIEQDGTVYISSLDTAMNQKAKQIIEDLVREVQVGETYHGKVKRIEKFGAFVELFKGKDGLLHISQIAEERINKVEDVFKLGDEVDVRVTEIDNQGRVNLSRKVLLKEQREKLEKEEAKDTANE

SEQ ID NO: 28143 - protein, 809 aa, Escherichia coli
MPVSACRAVARAVVGQQEAIKWDKAPCRFCGTGCGVLVGTQQGRVVACQGDPDAPVNRGLNCIKGYFLPKIMYGKDRLRQPLLRMKNGKYDKEGEFTPITWDQAFDVMEEKFKTALKEKGPESIGMFGSGQWTIWEGYAASKLFKAGFRSNNIDPNARHCMASAVVGFMRTFGMDEPMGCYDDIEQADAFVLWGANMAEMHPILWSRITNRRLSNQNVTVAVLSTYQHRSFELADNGIIFTPQSDLVILNYIANYIIQNNAINQDFFSKHVNLRKGATDIGYGLRPTHPLEKAAKNPGSDASEPMSFEDYKAFVAEYTLEKTAEMTGVPKDQLEQLAQLYADPNKKVISYWTMGFNQHTRGVWANNLVYNLHLLTGKISQPGCGPFSLTGQPSACGTAREVGTFAHRLPADMVVTNEKHRDICEKKWNIPSGTIPAKIGLHAVAQDRALKDGKLNVYWTMCTNNMQAGPNINEERMPGWRDPRNFIIVSDPYPTVSALAADLILPTAMWVEKEGAYGNAERRTQFWRQQVQAPGEAKSDLWQLVQFSRRFKTEEVWPEDLLAKKPELRGKTLYEVLYATPEVSKFPVSELAEDQLNDESRELGFYLQKGLFEEYAWFGRGHGHDLAPFDDYHKARGLRWPVVNGKETQWRYSEGNDPYVKAGEGYKFYGKPDGKAVIFALPFEPAAEAPDEEYDLWLSTGRVLEHWHTGSMTRRVPELHRAFPEAVLFIHPLDAKARDLRRGDKVKVVSRRGEVISIVETRGRNRPPQGLVYMPFFDAAQLVNKLTLDATDPLSKETDFKKCAVKLEKV

SEQ ID NO: 28144 - protein, 68 aa, Brassica napus
GRVGFCQSFMNEMYRYMGPDKDLPSEEVGVGTREMGYLFGQYRRLAGQFQGSFTGPRIYWAASSLRTE

SEQ ID NO: 28145 - protein, 236 aa, Calycanthus floridus
MTRRYWHINLEEMMEAGVHFGHGTRKWNPRMAPYISAKRKGIHITNLTRTARFLSEACDLVFDAASIGKHFLIVGTKKKAADSVASAAIRARCHYVNKKWLGGMSTNWSTTETRLHKFRDLRAEQKAGKLNRLPKRDAAMLKRQLSHLQTYLGGIKYMTGLPDIVIIIDQQEEYTALRECLTLGIPTICLIDTNCDPDLADISIPANDDAIASIRLILNKLVSAICEGRSSYIRNC

SEQ ID NO: 28146 - protein, 200 aa, Dunaliella tertiolecta
PKWNFDGSSTGQAPADDSEVYLVPRAIYKDPFRMGDNIMVMCETYEPPREKKDGTMNPLKPRPPTRALGCAQPMEKAKPQEPWFDIEQEYTLLNSVTKWPLGWPKGGYPAGQGPYYCSVGAGRSIRRDIPEVHYRSCLHAGIQISGVNGEVLPSQWEYQVGPVEGIAMGDQMWMSRYLMYRVAELFNVEVTFDPKPITGD

SEQ ID NO: 28147 - protein, 416 aa, Brassica napus
MASLAQQFTGLRCSPLSSSSRLTRRAAKNFPQNKSASVSPTIVAAVAMSSGQTRERLELKKMFEDAYERCRTAPMEGVAFTVDDFAAAIEQYDFNSEIGTRVKGTVFKTDANGALVDISAKSSAYLSVEQACIHRIKHVEEAGIVPGMVEEFVIIGENESDDSLLLSLRMIQYELAWERCRQLQAEDVVVKAKVIGANKGGLVAMVEGLRGFVPFSQISSKAAAEELLEKEIPLKFVEVDEEQTKLVLSNRKAVADSQAQLGIGSVVLGVVQSLKPYGAFIDIGGINGLLHVSQISHDRVSDIATVLQPGDTLKVMILSHDRDRGRVSLSTKKLEPTPGDMIRNPKLVFEKAEEMAQTFRQRIAQAEAMARADMLRFQPESGLTLSSEGILGPLGSDLPDDGVDLTVGDIPPAVDL

SEQ ID NO: 28148 - protein, 953 aa, Yarrowia lipolytica
MIEGISFASFVTHEKPKFVRALDFYKALGFLPTKEYKHGTDHHATDEEGAGSIQEVWLTSSRAGVPSVTVKLRLSRHGNEHVSLPNLKHDWRSLVPSLVYYAPDLDAVRAAITPFLHEDHSTLLERPSHTNFIELYAIDPMGNLVGFSRRENPYSSAMQKPFSADDIGPQNFSKPNETKIKGKKRIGVMTSGGDAPGMCAAVRAVVRAGIARGCEVYAVREGYEGLVKGGDLIEPLSWEDVRGWLSLGGTLIGTARCKEFREREGRLAGALNMVKNGIDALIVIGGDGSLTGADLFREEWPSLIEELVTNGSITAEQAERHRHLDICGMVGSIDNDMATTDVTIGAYSSLDRICELVDFIDATAQSHSRAFVVEVMGRHCGWLALMAGTATGADYIFIPEAAPDATQWAEKMTRVVKRHRSQGKRKTVVIVAEGAIDSDLNPITAKMVKDVLDGIGLDTRISTLGHVQRGGPPVAADRVLASLQGVEAIDAILSLTPETPSPMIALNENKITRKPLVESVALTKKVADAIGNKDFAEAMRLRNPEFVEQLQGFLLTNSADKDRPQEPAKDPLRVAIVCTGAPAGGMNAAIRSAVLYGLARGHQMFAIHNGWSGLVKNGDDAVRELTWLEVEPLCQKGGCEIGTNRSLPECDLGMIAYHFQRQRFDGLIVIGGFEAFRALNQLDDARHAYPALRIPMVGIPATISNNVPGTDYSLGADTCLNSLVQYCDVLKTSASATRLRLFVVEVQGGNSGYIATVAGLITGAYVVYTPESGINLRLLQHDISYLKDTFAHQADVNRTGKLLLRNERSSNVFTTDVITGIINEEAKGSFDARTAIPGHVQQGGHPSPTDRVRAQRFAIKAVQFIEEHHGSKNNADHCVILGVRGSKFKYTSVSHLYAHKTEHGARRPKHSYWHAIGDIANMLVGRKAPPLPETLNDEIEKNIAKEQGIIDPC

SEQ ID NO: 28149 - protein, 472 aa, Unknown
  Synechococcus sp. CC9311
MSKSHFGLIGLGVMGENLVLNAESNGFSSVVYNRTYSKTEDFLKGRGAGKNIQGATDLQDFVNKLERPRRILMMVKAGGPVDAVIEQISPFLDEGDLLIDGGNSEYHDTERRVAELESKSFGFIGMGVSGGAKGALEGPSMMPGGTKASYDAIESLVTKMAAQVEDGPCVTYIGPGGSGHFVKTVHNGIEYGIEQILAEGYDLMKRVGGMNGTQMADVFAHWNSTEELASYLVEITEVCLRTKDPDDGSDLIEKIQDKAGQKGTGLWTVVSALQMGASVPTIYAALNGRVMSSMKDQRVKAETILKGPAVKAFDLGTPADGMAPLMDAMVLSCMASYAQGMELLRIASAEHDYNLNMPSIAQIWKGGCIIRARLLQRIQDAFTTDPQLNNLLIDPWFANQVNTRLPGLAQVVAGAAEAGIPVPCLSNTLDYINSYRTARLPQNAVQAMRDCFGSHTYQRVDKEGTFHTEWLD

SEQ ID NO: 28150 - protein, 246 aa, Saccharophagus degradans
MPTVSMRDMLQAGVHFGHQTRYWNPKMGKYIFGARNKIHIINLEHTVPAFNEALAIVKQLGSQKKKVLFVGTKRAAQKSIKEQAERSNMPFVSHRWLGGMLTNYKTIRASIRRYRELETQSQDGTFEKLTKKEALVRTRIMEKLEKSIGGIKDMGGLPDALFIIDVEHERIAIQEANKLGIPVIGVVDTNSDPAGVDYVIPGNDDAIRAIKLYATAVADACIEGAADSASVPNKDEFVEEKAADAE

SEQ ID NO: 28151 - protein, 221 aa, Saccharomyces cerevisiae; identical to SEQ ID NO: 561

SEQ ID NO: 28152 - protein, 300 aa, Prochlorococcus marinus
MSWKVADIPDQKGRVALVTGANSGLGLETAKALLNKGARVIMACRSRPKGEAVRQIILESNDSTKLDLIELDLADLASVRRAAEQVERQYSRVDLLINNAGVMATPQTLSKQGLELQFAVNHLGHMALTLKLLPLLAKQHGARVVTVTSGAQYMGRIAWEDLQGIKHYDRWAAYSQSKLANVMFALELDKRVRNAASGIASLLAHPGLARTNLQPKSVAANKSWQEGLAYRLMDPMFQSAAMGSLPQLHAATAPTAQGGEQYGPRFNFRGYPKLCRIAPLALREEDRQRLWSISEKLLEI

SEQ ID NO: 28153 - protein, 687 aa, Oryza sativa
MAHRAGCLSMLLTAAVVLLALAPRGAAYPWQVCGTTGNFTTNSTYQANLDAVAAVLPRNTSSSPDLFATAMVGAVPEQVSALALCRGDANATECSGCLATAFQDVQNMCAYDKDAAIYYDPCILYYSNVPFLSSVDNAASTNRVNLRNVTSDPGRFNGMVAALVNATADYAARNSTRRYASGEAVLDRESEFPKVYSWAQCTPDLTPAQCGDCLAAIIAKLPRLFTNRIGGRVLGVRCSYRYEVNPFLNGPVMVHLTAPPIPTASPPAAAAAAAGEGKDYNVPRLVLAILLPTIAALVLINILVWLCFWRRMERLRSGATQPYSSNFAESENISSVESMLIDISTLRAATGCFAERNKLGEGGFGAVYKGTLPDGDEIAVKRLSKSSTQGVGELKNELALVAKLQHKNLVRLVGVCLEQEERLLVYEFVPNRSLDQILFDADKRQQLDWGKRYKIINGIARGLQYLHEDSQLKVVHRDLKASNILLDMNMNPKISDFGLARLFGRDQTQGVTNLVIGTYGYMSPEYAMRGNYSLKSDVFSFGVMVLEIVTGKKNNDCYNSLQSEDLLTLVSTNHMILLVCSWKNEVWEQWTARAVSEAVDPVMGGGFSWSDVMRCIHIGLLCVQENPADRPVMSSVVMMLGSDTVSLRAPSKPAFCARRNGGGGGGAGASSGGTSSGTSTAASVQGK

SEQ ID NO: 28154 - protein, 458 aa, Bacillus halodurans
MSKQQAPVNKNDVVEVTIEDLTHDGAGVAKVDGYALFIPKALPGERLKAKVVKVKKGYGFGRVLNMIEASPDRVEAPCPVFNQCGGCQLQHMSYDAQLRYKQKQVQDVLERIGKITAVTVRPTIGMNEPWRYRNKAQVPVGEREGGLIAGFYQERSHRIIDMDECMIQHEENDKVIRQVKELARELGIRGYDEEKHRGTLRHVVARYGKNTGEIMVVLITRGEELPHKKTLIERIHKAIPHVKSIVQNVNPKRTNVIFGDKTKVLWGEEYIYDTIGDIKFAISARSFYQVNPEQTKVLYDQALEFANLTGSETVIDAYCGIGTISLFLAQQAKHVYGVEIVPEAISDAKRNARLNGFANVQFAVGDAEKVMPWWYAQGVRADVIVVDPPRKGCDEALLKTILNMKPDRVVYVSCNPATLARDLRVLEDGGYETKDVQPVDMFPWTTHIESVAVLELKN

SEQ ID NO: 28155 - protein, 326 aa, Unknown
  Synechococcus sp. RS9917
MKRLLITGGSSGIGLEAARRLARSGHQLTVFCRTAERAEQTEQQLRAAGAAPSQLACIAVDLADLASVDRACQQLLDQGQPLDGLVLNAGQQRAGTAAPVFTPQGIEITFAVNQLAHQLIATRLLPLLQAGPQPRIVITASEVHNPASGGGRVGQPADLGDLAGLRAGAGFVMLDGSDRFDGDKAYKDSKLCNVLLGRELDRQLEGSMPVISWSPGLVIPRSSAGFFRHNRQNNPLGMALFALVARDLLRLTESVPTAGRLLADLVTDAAFSSPGFSYWSNQLVRPGLHRFEATATSAAGADHELAAALWRLSEALIHRPWERAQA

SEQ ID NO: 28156 - protein, 118 aa, Pterospora andromedea
FLSEACDLVFDAASVGKQFLIVGTKKIVADLVVRAAIRARCHYVNKKWIGGMLTNWSTTEKRLQKFRDVRMEQKMGKLQYLPKKDAGKLKRELSHFMAYLGGIKYMTELPDVVIILDQ

SEQ ID NO: 28157 - protein, 427 aa, Heliobacillus mobilis
MLWQRGGKHMNLVSELALKGKQAKDAAYKLASISSQIKDKALEAMAYALVAQEEEILAANALDVEAGRNKGMSNALLDRLMLNKKRIEEMAEGLYALVSLPDPIGEVVRQWRRPNGLEIGQVRVPLGVVGIIYEARPNVTVDAAGLCLKTGNAVLLRGGSEAIRSNMAIVKVIAAAAEEAGLPSGSIQLVEDTSREVAQQMMTMNKYLDVLIPRGGAGLIQTVVKNATVPVIETGVGNCHVYVDSHADLDMAENIVINAKTHRPGVCNAMETLLVHQDVARKFLPHVGKRLQEMNVELRGCPRTLALIEGAKEATEEDYQTEYLDLILAVRVVDSFEEALAHIRRYSTGHSEAIVTNDYLRAREFTRCVDAAAVYVNASTRFTDGFQFGMGAEIGISTQKLHARGPMGLNEMTTIKYVCYGDGQIRQ

SEQ ID NO: 28158 - protein, 408 aa, Rickettsia rickettsii
MNIKQPFKILSMDKKLGNIVVSRRAILEESRSEARDEMLSKIKEGMVLEGTVKNITDYGAFIDLGSVDGLLHLTDISWGRVNHPSEVLDFNQKVKVMVIKFDEKTKRISLGIKQLDSNPWEAIKEEFPVGKQMTGKVTNFADYGVFIELKDGLEGLVHSSEISWLKSNQNPRKTLTIGQEVEFVVLEVDTEKHRVSLSIKQCQENPLTKFAENNPVGTIIKAPIRNITDFGIFVALGNNMDGMIHEGDISWEDKGTALLKSYKKGDEVECKVLAINIEKEQVSLGIKQLSPNPYQEISDEYKKGTIVKALITEVKDEGLEVLLNDKVAGFIKSTELSDEKDEQKPEMFQIDKEIEAKVVSIEKSTGRILLSVKAHKIAERQKALKAYGSSDNTTNMGDILANALEDKK

SEQ ID NO: 28159 - protein, 363 aa, Solibacter usitatus
MMTPLSKSSASTLKDAWYCAGWSHELRYPRILGRKLLNRQLALFRDQQGRLHALDAACPHRGADLSLGHLVEGHIQCPLHGWRFDDTGKCVCIPSQLPEVKIPPGAMASTYRVVERQGIIWIWMGAVRDPMPAPPHQDVWEASPARHRHFLPPQLWRCSFFNAVENAIDNTHLPFLHAGLLGPNQQQLYPTQNLVVDEDLRGFRGEDSPESPWGFPRSRQIFDGVLERVVAAWMGMNEIRREYYRFDLGGSLSFYVEWDSGTWDVLAGHWTPSDSFHSWYFGMSIRTRATHWVGDIFQKWFGKKLSLQDKLGVERLLSNEPDNLPSTVSVVGDEPALTFRRIHNYHVNHQQGDGLAASSTNWV

SEQ ID NO: 28160 - protein, 82 aa, Arabidopsis thaliana
  misc_feature (20)..(20): Xaa can be any naturally occurring amino acid
FKGLGPFRLGGSSSALPKLXTTGGKSSSVVGGAELSPSMVLGLRPGFSLFLGRLVFLNFQGGTVANQGLPEQNGKPHFEAGD

SEQ ID NO: 28161 - protein, 430 aa, Bacillus subtilis
MKTTINQVYKHVGEEVTIGAWVANKRSSGKIAFLQLRDGTGFIQGVVVKAEVEESIFQTAKSVTQETSLYIKGIVKEDERSPLGYELAVTDIEVIHEATDYPITPKEHGTEFLMDHRHLWLRSKRQHAIMKIRNEIIRATYEFFNNEGFVKVDPPILTGSAPEGTTELFATKYFDEDAYLSQSGQLYMEAAAMALGKVFSFGPTFRAEKSKTKRHLIEFWMIEPEMAFVEFEENLQVQENYVSFIVQSVLKNCKIELNTLGRDTSKLEQIKAPFPRITYDEAIEFLKEKGFDDIEWGDDFGAPHETAIAEHYDKPVFITRYPTSLKPFYMQPASDREDVVLCADLIAPEGYGEIIGGSERIHDMELLESRLKEHGLDSDAYKWYAELRKYGSVPHSGFGLGLERTVAWISGAPHVRETIPFPRLLNRLYP

SEQ ID NO: 28162 - protein, 486 aa, Mannheimia succiniciproducens
MNIQTSAPKVEVRLGFKLQGLLIAVLVGIAILLIPTPEGLSTKAWGMFALFVATIVAIIAKAMPMGAATLVALVISGLSGLTPLSPAKGEVGMLSGFSNGTIWLIAIAMFLSRAVIKTGLGKRIALYFVARFGKRMMGVAYGIALADVVIGPGIPSASARGGGIMYPIMQSIADAYNSKPGPTARRAGAFLAIAVSQIDTIVCTMFLTAMAGNPLIAELAKSQGVEITWMTWFLGAIVPGIVSLILLPYFVYLIYPPELKDTPKMAEMAREELNSMGKMSQAEWILALDFILLLLLWTVGDLVFHIPATVSAFVGLVILLLTNIMSWKNIISETAAWDTMFWFAVLVMMANALNKYGTISWISTHIADSVGSFSWPVAFTILVLVYFYTRYFFASAMAHISAMYLAFVAAAIAVGTPPIIAAIGLGYTSTLSMSLTQYAGGPGPALYGSGYNSTGQWWGVSFAVSILSLAIWFSVGGVWMKLLGWW

SEQ ID NO: 28163 - protein, 661 aa, Oryza sativa
MDRRLILSVAVAVALLVPRSAGEPWPVCGQDFGTFTPKSRFFANLQLIAATLPGNASSSPDLYATAVDVGAVPEQVTAAALCRGDVSASSCLGCLTQAFADLPNACGNSREAATYYDRCMVSYSAINFLSGGAGGEDPARIDAYTVNNENKVTSEQGRYNRLVAALVNATADYAAYNSTRRYAAGEADFDAALPKVYSLAQCTPDLSPARCRSCLAKIVAQELWSYKDDIGGRTLSVRCSFRIETKPFLNGTTMVRLPATSAPSPAPPVNATPSAATPGRETKYKVPRLVLIILLPIIAAVNLVVCFCVWRRKRPVITKAKQTNANYYAEADDVDSVDSMLMDISTLRAATGDFAESNKLGEGGFGAVYKGVLPDGNEIAVKRLSKSSTQGVQELKNELALVAKLRHKNLVSFVGVCLEQHERLLVYEFVPNRSLDLILFDTEKREKLDWEKRYRIINGVARGLQYLHEDSQLKVVHRDLKASKILLDANMNPKISDFGLARIFGQDQTQAVTNRVVDTYGYMAPEYMMRGNYSVKSDAFSFGVMVLEIVTGRKNNDFYNNSHQSEDLLNTIWERWMAGTVDEMVDPAMSRYVSASDVRKCVHVALLCVQENPADRPVMSSVVMMLDSETVSLQVPSKPAFFARNGGAKPGVASDESTASV

SEQ ID NO: 28164 - protein, 159 aa, Listeria monocytogenes
MNVHDFSEKAMNGKEIALSDYKGKVLLIVNTASKCGLTPQLEGLEAMYKKLGGDNFEILGFPCNQFLRQDPGSDEEILEFCQMNYGVTFQMFSKIKVKGKDASPLYKYLTEQTGGKKVEWNFAKFLIDENGEVIERFPSKMKPEDFEDKVEALVAKVNN

SEQ ID NO: 28165 - protein, 218 aa, Triticum aestivum
  misc_feature (201)..(201): Xaa can be any naturally occurring amino acid
MGRRPARCYRQIKNKPYPKSRYCRGVPDPKIRIYDVGMKKKGVDEFPSCVHLVSWEKENVSSEALEAARIACNKYMTKNAGKDAFHLRVRVHPYHVLRINKMLSCAGADRLQTGMRGAFGKPLGTCARVDIGQVLLSVRCKESNAVHADEALRRAKFKFPGRQKIIRSRKWGFTKFNKADYIKYKSEGRIVPDGVNAKLLXGVHGPIAKRAPGQAILA

SEQ ID NO: 28166 - protein, 358 aa, Solanum chilense
MDLPVSAIGFEGFEKRLEISFVEPGLFADPNGKGLRSLTKAQLDEILGPAECTIVDNLSNDYVDSYVLSESSLFVYSYKIIIKTCGTTKLLLAIPPILRLAETLSLKVQDVRYTRGSFIFPGAQSFPHRHFSEEVAVLDGYFGKLAAGSKAVIMGNPDKTQKWHVYSASAGTVQCNDPVYTLEMCMAGLDREKASVFYKTEESSAAHMTVRSGIRKILPKFEICDFEFEPCGYSMNSIEGAAVSTIHITPEDGFSYASFESVGYDPKTTELGPLVERVLACFEPAEFSIALHADVATKLLERVCSVDVKGYSLAEWSPEEFGKGGSIVYQKFTRTPYCESPKSVLKGCWKEEEKEEKE

SEQ ID NO: 28167 - protein, 360 aa, Synechococcus elongatus
MAVRKLGVLTSGGDCPGLNAVIRAIARHAVGNYGWELWGIAYATQGLLKRQAIALSPHHFDRQSLDPLLCSGGTILGSINRGDTLAHQAEILAGYQELGLDALIGIGGDGSLAILRQLAEAGRWQFIGIPKTIDNDVALTERAIGFDTAIHTVAEALLSLGSTAASHDRIMIAEVMGRQSGHLALQGGIAGGADVILLPEIPYRLLELCHYLQQLRDRWQRRYAVIAIAEGTHHPPEVTQGPGSLGEQLVQAITAQDPTLDARVTVLGHVQRGGNPVASDRLLATQMGYAAVERLAAGASGEMMAWQGGRVVSVPLEAVCLQSPTLVDPHSPPVDTAAGLGIFLGDRSLTPWRGSACPTH

SEQ ID NO: 28168 - protein, 231 aa, Eucalyptus globulus
WELMNEPRCTSDTSGRTIQAWITEMASFVKSIDRNHLLEVGLEGFYGQSTPQRKRLNPGFDIGTDFIANNRIPGIDFATAHSYPDQWVSSSNDQYQLSFLNNWLNTHIQDAQYILRKPILLTEFGKSQKDHGFSTYQRDQLFNMVYYKVYASAKRGGAAAGSLFWQLLTEGMDSFRDGYEVVLNQSPSTANIIAYQSHKLYQIRKIFARMRNVDRWKRARAARNRGRPIGN

SEQ ID NO: 28169 - protein, 401 aa, Xanthomonas oryzae
MASAFPLLTDLRGRAVLVVGGGADAERATAQLLQAGALPLVGAPELTAQLRRWAQSRQLRWLEGRFDTAWLALPDQPVWLAIAASESATLNDAIRHAANARRLLTHDAAPAASATAPVRPPAPRSAIGTLAPGSVSLVGAGPGDPGLLTRHALRALRQAEVVLHDRLVSPQILRLARPGARLIAVGKSAQGHSTRQEQIHALMLEHARAGHRVVRLKGGDSFVFGRGGEELEFLRAHGIGFQVIPGITAAVACAAYAGIPLTHRDHAQSLRLITAHCKDSLDTLDWHALGQERQTLAFYMGVAGLDAIQQRLLQAGRAASTPFALVENGSRPQQRVITGTLASLATIARQHAVAAPALLILGEVAALAQTLHWFGNAPLSAPLLPHSPLATPDTPTLAHAA

SEQ ID NO: 28170 - protein, 394 aa, Oryza sativa
MAAATTSRRGPGAMDDENLTFETSPGVEVISSFDQMGIRDDLLRGIYAYGFEKPSAIQQRAVLPIISGRDVIAQAQSGTGKTSMISLSVCQIVDTAVREVQALILSPTRELAAQTERVMLAIGDFINIQVHACIGGKSIGEDIRKLEHGVHVVSGTPGRVCDMIKRRTLRTRAIKLLILDEADEMLGRGFKDQIYDVYRYLPPELQVCLISATLPHEILEMTSKFMTDPVRILVKRDELTLEGIKQFFVAVEKEEWKFDTLCDLYDTLTITQAVIFCNTKRKVDWLTERMRSNNFTVSAMHGDMPQKERDAIMGEFRSGATRVLITTDVSLVINYDLPNNRELYIHRIGRSGRFGRKGVAINFVKKEDIRILRDIEQYYSTQIDEMPMNVADLI

SEQ ID NO: 28171 - protein, 319 aa, Xanthomonas oryzae
MALYDNILDTIGHTPVVKLQRLAPDNVRLYVKVESFNPGGSVKDRLALAIILDAEQRGLLKPGDTIVEATSGNTGVALAMVAAARGYKFVATMVETFSIERRKLMRAYGAKVILTPAAERGSGMVRKAKELAEQHGWFLASQFANPANTAYHRNTTAAEILRDFAGHRLDHFVTGWGTGGTLTGVGEILRVARPEVRITASEPAGAALLQGQDWKPHKIQGWTPDFVPEVLNRDVAHEVLSVEDTDAITVARRLAAEEGIFTGISGGATVATALQVAEGATPGAVILAMLPDTGERYFSTPLFADVNEGSDDDWLAGLP

SEQ ID NO: 28172 - protein, 356 aa, Vitis vinifera
MSLLADLQNINLSDSTEKIIAEYIWIGGSGNDLRSKARTLSGPVTGPAQLPKWNYDGSSTGQAPGEDSEVILYPQAIFKDPFRGGDNILVMCDAYTPGGEPIPTNKRFNAAKIFSHPEVTAEEPWYGIEQEYTLLQKDVNWPLGWPVGGFPGPQGIIYCGIGADKAFGRDIVDSHYKACLYAGINISGINGEVMPGQWEFQVGPAVGISAGDELWVARYILERITEIAGVVVSFDPKPIKGDWNGAGAHTNYSTKSMRNTGGYDVIKKAIEKLGLRHKEHISAYGEGNERRLTGRHETADINTFCWGVANRGASIRVGRDTEKEGKGYFEDRRPASNMDPIVVTSMIAETTILWKP

SEQ ID NO: 28173 - protein, 224 aa, Eucalyptus globulus
WELMNEPRCMTDPAGNTLQDWLEEMSTFVRSIDKKHLLTVGLEGFYGPKNPKSLTVNPADWAALYGSDFVHNSNLPNIDFASAHIYPDHWFHEIEFEESVKFVSKWVRSHIDDGDRVLKKPVMFTEFGYSNQNPNFHPSQRDRFFKTIFDEIYASARKNGAGAGSFVWQFFVGGMEEYNDDFGIVPWQRSSTYQLITEHSCRLAALRGLNQLKGSLRELCLQDK

SEQ ID NO: 28174 - protein, 182 aa, Eucalyptus globulus
GQEGFYGPNSPKKPTVNPGEYFSLLGSDFIRNSEIPNIDFASAHIYPDHWFKNQDFEEELKYVALWTRSHIDDGDRILRKPIMFTEFGYSTLNKDFDPSKRDRFFKTIYDVIYKSAKKQGAGAGSFVWQFWVGGMEKYNDDFGIVPWERPETYKLITQHSCRMARIRGSAELKGNLKELCSQ

SEQ ID NO: 28175 - protein, 402 aa, Glycine max
  misc_feature (149)..(149): Xaa can be any naturally occurring amino acid
MISSLRQPVVGISGSDLPLRQRHATPIKARSFLPSLSREKGQGSLVSVQKPLHIGASLGVGNFASVKSDAKRGDLVKCEAYEADRSEVEGASTPSEAAKKVKIGIYFATWWALNVVFNIYNKKVLNAYPYPWLTSTLSLACGSLMMLIXWATGIAEAPKTDPEFWKSLFPVAVAHTIGHVAATVSMSKVAVSFTHIIKSGEPAFSVLVSRFLLGESFPVPVYLSLIPIIGGCALAAVTELNFNMIGFMGAMISNLAFVFRNIFSKKGMKGKSVSGMNYYACLSILSLAILTPFAIAVEGPQMWAAGWQTAMSQIGPQFIWWLAAQSVFYHLYNQVSYMSLDQISPLTFSIGNTMKRISVIVSSIIIFHTPVQPINALGAAIAILGTFLYSQAKGEVRLNLQD

SEQ ID NO: 28176 - protein, 606 aa, Oryza sativa
MQRSRRALLKRKAAAAAAEEEEAGVGVATAAAAGRRRRRRLYGFSVSLVVACWVVLLLLNPLVGHGNGQRDEGIFADEGSSDPSFDSVEPTLSEGSVDSVVQQENGENHALPGDSCAKPDENHVLSEETLLEKDQLCSNDEAQGDGMDALPKDNVDQGENLPRTDDDSVVHPEGEVESEGVPRPARLSRVVPPGLDEFKTRAIAERGKGVPSGQPGNVIHRREPSGKLYNYASAAKGAKVLEFNKEAKGASNILDKDKDKYLRNPCSAEGKFVIIELSEETLVDTIAIANFEHYSSNLKEFEMLSSLNYPTDSWETLGRFTVANAKIAQNFTFPEPKWARYLKLNLLSHYGSEFYCTLSMLEVYGMDAVEKMLENLIPVENKRLEPDDKMKEPVDQQTQLKEPTEGKESSHEPLDEDEFELEDDKLNGDSSKNGAHDQVTETRPIQAGRIPGDTVLKVLMQKVQSLDVSFSVLERYLEELNSRYGQIFKDFDADIDTKDALLEKIKLELKHLESSKDDFAKEIEGILSWKLVASSQLNQLLLDNVIIRSELERFREKQADLENRSFAVIFLSFVFGCLAIAKLSIGMIFNTCRLYNFEKFDRFQIS

SEQ ID NO: 28177 - protein, 82 aa, Glycine max
  misc_feature (14)..(14): Xaa can be any naturally occurring amino acid
ARDAIGVTSLYIGXGLYGSVWISSEMKGLHDDCGYFEVFLPGHLYSSKQIGCRRLYNPPWFSEAIPSALYEPLVSRHPFEQA

SEQ ID NO: 28178 - protein, 267 aa, Nicotiana tabacum
LLPCYLKSMYQSRGIYVNAKVAFCIHNIAYQGRFSFADFSLLNLPDEYKSSFDFIDGYEKPVKGRKINWMKAGILESHRVVTVSPYYAQELISGVDKGVELDNVLRKTCITGIVNGMDIQEWNPATDKYTDVKYDITTVMDAKPLLKEALQAAVGLPVDRKIPLTGFIGRLEEQKGSDILVAAIHKFIGWDVQIIVLGTGKKEFAQEIEQLEVLYPNKAKGAAKFNVPLAHMITAGADFMLVPSRFEPCGLIQLHAMRYGTVPICAS

SEQ ID NO: 28179 - protein, 281 aa, Saccharomyces cerevisiae
MSEYQPSLFALNPMGFSPLDGSKSTNENVSASTSTAKPMVGQLIFDKFIKTEEDPIIKQDTPSNLDFDFALPQTATAPDAKTVLPIPELDAAVVESFFSSSTDSTPMFEYENLEDNSKEWTSLFDNDIPVTTDDVSLADKAIESTEEVSLVPSNLEVSTTSFLPTPVLEDAKLTQTRKVKKPNSVVKKSHHVGKDDESRLDHLGVVAYNRKQRSIPLSPIVPESSDPAALKRARNTEAARRSRARKLQRMKQLEDKVEELLSKNYHLENEVARLKKLVGER

SEQ ID NO: 28180 - protein, 627 aa, Oryza sativa
  misc_feature (214)..(214): Xaa can be any naturally occurring amino acid
MAISMASPLSSWPWAFLGSYKYLLYGPVVGKVVQEWREQGRLPLGTSWCLHLILLLALRSLTYQLWFSYGNMLFFTRRRRVVDDGVDFRQIDTEWDWDNMVIMQTLIAAVLVTSRVFPATSDLSAWDLRGWAIAVVLHVAVSEPAFYWAHRALHLGPLFSRYHSLHHSFQATQALTAGFVTPLESLILTLVAWAPLAGAFMAGHGSVSLVYGHXLLFDYLRSMGYSNVEVISHKTFQDFPFLRYLIYTPSYLSLHHREKDSNFCLFMPLFDALGGTLNPKSWQLQKEVDLGKNHRVPDFVFLVHVVDVVSSMHVPFAFRACSSLPFATHLVLLPLWPIAFGFMLLQWFCSKTFTVSFYKLRGFLHQTWSVPRYGFQYFIPSAKKGINEMIELAILRADKMGVKVLSLAALNKNEALNGGGTLFVRKHPDLRVRVVHGNTLTAAVILNEIPGDVAEVFLTGATSKLGRAIALYLCRKKIRVLMLTLSTERFMNIQREAPAEFQQYLVQVTKYQAAQNCKTWIVGKWLSPREQRWAPAGTHFHQFVVPPIIGFRRDCTYGKLAAMRLPEDVEGLGTCEYTMGRGVVHACHAGGVVHFLEGWDHHEVGAIDVDRIDAVWNAALRHGLTPA

SEQ ID NO: 28181 - protein, 118 aa, Pterospora andromedea
FLSEACDLVFDAASVGKQFLIVGTKKIVADLVVRAAIRARCHYVNKKWIGGMLTNWSTTEKRLQKFRDVRMEQKMGKLQYLPKKDAVKLKRELSHFMAYLGGIKYMTELPDVVIILDQ

SEQ ID NO: 28182 - protein, 346 aa, Volvox carteri
MQTMRAPAAQGAATRVASRRVFRPVASTKVSTAVTTDVSKRTVPTALEEGEMPLNTYSNKAPFKAKIRSVETITGPKATGETCHIIIETEGKIPFWEGQSYGVIPPGTKINSKGKEVPHGTRLYSIASSRYGDDFDGKTASLCVRRAVYVDPETGKEDPAKKGICSNYLCDATPGTEIVMTGPTGKVLLLPADANAPLICVATGTGIAPFRSFWRRCFMENVPSYKFTGLFWLFMGVANSDAKLYDEELQALAKAYPSQFRLDYALSREQKNRKGGKMYIQDKVEEYSDEIFDLLDNGAHMYFCGLKGMMPGIQEMLERVAKSKGLNYEEWVEGLKHRNQWHVEVY

SEQ ID NO: 28183 - protein, 806 aa, Coccidioides immitis
MASYNPPGHLPVPVPKRRRVAILTSGGDAPGMNGVVRAVIRMSIHCGCEAYAIHEGYEGLVQGGELIRRMHWEDVRGWLSRGGTLIGSARCMSFLQREGRLKAAKNMVTRGIDALIVCGGDGSLTGADVFRSEWPGLLDELVKKGELTANQTSPYKTLNIVGLVGSIDNDMSTTDATIGCYSSLHRICEAVDEVFDTAASHQRGFVIEVMGRHCGWLALMSAISTGADWLFIPEMPPRDGWEDDMCEIITQARKRRTIVIVAEGAQDRSLNKITSDAVKAILSNRLKLDTRVTVLGHTQRGGPACAYDRWLATLQGTEAVRAVLEATPDSPSPIITIRENKIERGSLIDAVAATKKVAKCVAEKRFEEAMQLRDSEFKAYHRAYINTTTPHHPKMLLPQEKRMRIAIIHVGAPAGGMNPATRAAVAYCIARGHTPVAIYNGFPGLCRHHADKPLGSVREVNWLESDSWVNEGGSEIGTNRGLPSEDMPTTAYCFERYKFDALFIIGGFEAFTAASQLRKARKDYPSLKIPIVVLPATISNNVPGTEYSLGSDTCLNTLVNFCDVIRQSASSSRRRVFVIETQGGRSGYIAVMAGLAVGAYAVYIPEEGIDIKMLARDIEYLRHNFATDRGASHAGKIILRNEKASSTYTTQVIADMIKEEAKGRFESRAAVPGHFQQGGKPSPMDRIRALRLALRCVQHLESFSGRSRDEIDADEMSSVVIGIRGSEVVFGPMSGEEGLEATNTDWEHRCPRNQFWMKLRNLVDTLSGRPSESKDGKVKLADDEGWDSGAVSDPCHLCGTPKIAIG

SEQ ID NO: 28184 - protein, 119 aa, Pterospora andromedea
FLSEACDLVFDAASVGKQFLIVGTKKIVADLVVRAAIRARCHYVNKKWIGGMLTNWSTTEKRLQKFRDVRMEQKMGKLQYLPKKDAVKLKRELSHFMAYLGGIKYMTELPDVVIILDQQ

SEQ ID NO: 28185 - protein, 685 aa, Oryza sativa
MAASHVALSVPVAAAVALLLLVLPRAAESYPWAKCNDTAGDFPARRSSSYLASINLIAATLPGNASASPDLFATAEGVGAAPDQVSALALCRGDANASTCLACLTQAFLDLPNACAYDKVAAIFYDSCLLAYSNATIAAGDFSSEKIPIYGFYNNANATTEQARFNRLVAALVNATADYAARNSTRRRYASGQADFNAEFPKVYSWAQCTPDLTPASCRSCLAQIIGRGIGFFENRVGGFVRAVWCSFQYSTTPFLDGPMLVRLQGTSGASPAQAPSPAAVVPAVNQTPPAATPTLEGVNSGRKYSIPGLVLIILLPTIAAINVVVGLCFWRRRRPVKEAKRTYANYSTEAEDIENLDSMLIDISILRSATGDFAESNKLGEGGFGAVYKGVLPDGYEIAVKRLSKSSTQGVEELKNELDLVAKLKHKNLVSLVGVCLEQQERLLVYEFVPNRSLDLILFDTEKSEQLDWEKRYKIINGIARGLQYLHEDSQLKVVHRDLKASNILLDANMNPKISDFGLARIFGRDQTHAVTKNVIGTYGYMAPEYLTRGNYSVKSDVYSFGVMVLEIVTGRKNNHSYNSQQSEDLLTMIWEQWVAGTVLEMVDPSMNSFFSESNVMRCIHIGLLCVQGDPAERPVMSSVVLMLGTDTVELHAPAKPTLFARKGGEESGVASGGMSIVSLEEQS

SEQ ID NO: 28186 - protein, 264 aa, Volvox carteri
MAFVLSKSSAFGVAAKPVSRRSSVAVKASAVPENVKEARAWIDAWKSKQGALSRTPAFPAGCPAATLPGYLDGTLPGDFGFDPLYLGAEPSKLKWYAQAELVHARFAMLAVAGILVPELLTNIGFSWPGAGVAWYDAGKFQYFAPASSLFGVQMLLFAWAELRRYQDFVKPGSANQDPIFSNNKLPDGNEPGYPGGIFDPFGWSKGDMKSLKTKEIKNGRLAMLAFAGFAAQAYTTGTTPLKNLATHLADPWATTVWQNDLARL

SEQ ID NO: 28187 - protein, 485 aa, Glycine max; identical to SEQ ID NO: 564

SEQ ID NO: 28188 - protein, 334 aa, Gibberella zeae
MQSILQKATGIGPQVIKPENLQGRVAIVTGGALGIGYEVSRALAHAGCKVIMVNRKEEQGTSAIEAVKNEKHDADIDWKECDMGNLSQIREVFGGFRESLDRLDFLVLSAGINTNQFGLDSDGIERHFGVNFLGHFYVCNQLWPLLRKTSKMENVSPPRVVFEASEMHRLAQLSNVQFKTKEEINDPDLDPTARYNRTKLAMILFAKYGLAGKVIAENKDKIYALSVHPGAVNTAMQQQWKDAYPGLTGKLLSWTMQAIGRDVEQGSYSALWALTSSRIEEENLNGYYFVDPDKEGEETSQASNPELASNLWDLSTSFIKEKLGEDALADWNGS

SEQ ID NO: 28189 - protein, 118 aa, Sarcodes sanguinea
  misc_feature (92)..(92): Xaa can be any naturally occurring amino acid
FLSEACDLVSAAASQGKQFLIVGTKKRVADLVVRAAIKARCHYVNKKWIGGMLTNWSITEKRLHKFRDVRMEQKMGRLKSIPKRDVAKLKRXLYHFQTYLGGIQYMMGLPDIVIILDQ

SEQ ID NO: 28190 - protein, 118 aa, Sarcodes sanguinea
FLSEACDLVFAAASQGKQFLIVGTKKRVADLVVRAAIKARCHYVNKKWIGGMLTNWSITEKRLHKFRDVRMEQKMGRLKSIPKRDVAKLKIKLYHFQTYLGGIQYMMGLPDIVIILDQ

SEQ ID NO: 28191 - protein, 581 aa, Schizosaccharomyces pombe
MSHSDYNFDIEQNAFEKEAPKVSIERKGDVVEEEVIATGEVENYAEPKSRNFLQRFFDDFKPALTTRGDGVALKRKLTSRHMQMISVGGAIGSGLYVGSGSAFADGGPASVIINYILIGIMMIFVIYALGELAIAYPVAGSFNTYATRFIDPAWGFAVSWNYFLNYFVTCPLELTTCAITFKFWTEINSAAWISIFLAVVIVINLFGVRAYGEVEFILSTIKVIATVGFIILAIIINCGGVPTDHRGYIGGSIIKQKPFRHGFKGFCSVFTTAAFSFSGTEIIGLAAAEVGNPRKSVPSAVKQVFWRIAIFYVVSLILIGLLVSPDDPRLMGNGDVSVSPFVLAIQEANIKGLPSVFNAVIIISVVSVTNSTTYTAARTLQGMATLKQAPKFFSYTDRVGRPLIAMVVVLLFGFFAYINEADKNGSDISDTVFDWLLAISGLSSFFTWGSICLSHIMFRLAFKKQGHSLKELGFVSPMGIWGSVIGLGFNILCLMAEFYVSLFLIGGSPNANDFFQGYLAACIALAFFIGYKIYDRSHIPSLDKLDIDTGLKTYDNQDEEKEEYSSKGPLNILKKAWNAVC

SEQ ID NO: 28192 - protein, 285 aa, Picea glauca
MEHMNTTAQSSSSLYGVHMVEYGGDVGVGSMMALMTEHQPESESIMTSIPIPSSYSSYSHGHGHGHGHGHGHGQSECLLSAAAMFQTSRPCQGANKFEPANAHIGGGGGAGHFVMEQFIPEQAVISDSSISSVKTEVCSGSGGTGVPGQFELIRRKEEGRCARAYAEPSFVVTPLVTSLPPQQQEARMVTSLAVDMDSSCSCKPIEADAMKAKIIAHVHYPRLVAAYIDCQKVGAPPDVVSELDELSQKCHAQQCVATISIGADPELDQFMEAYCEMFIKYQEEL

SEQ ID NO: 28193 - protein, 175 aa, Glycine max
MAVSVSASSAIASLNSERSTRLAPSLVSASSSAKQSSLQFTSPTRLLRISTPRAPAPSRPRFLPLVQAKKQTYNSFEDLLANSEKPVLVDFYATWCGPCQFMVPILNEVSTRLQDKIQVVKIDTEKYPTIADKYRIEALPTFIMFKDGDPYDRFEGALTADQLIERIEAGLKVKQ

SEQ ID NO: 28194 - protein, 878 aa, Clostridium perfringens
MNYLEVKKDIYWVGSLDPELRVFDIIMYTPYGTTYNSYVVKGSEKIAVFETVKEKCFDDYLSKLNSLGIDPKSIDYIVVDHTEPDHAGSVEKLLELSPKAKVIGSMQAIEFLKDIVNKDFEYIVVGDNDTISLGNKTLQFISAPFLHWPDSMYTYIPEDKALITCDSFGSHYSCEEVFNDLVPNEEEYLDALRYYYDCIFGPYKPYVLKAIDKIKDLDIELVCPGHGPILRQDPWKIINTYKEWSTPVKPKINGDKKVTIPYVSAYGYTKELAEEIAKGIQCEHNVEVKLYDLTYSKQEDVLADIGESDGILFGSPTIVGELLPPIRILLANLNPIIHGGKYAAAFGSFGWSGEAVPRIEARLKELKMNIFGPGLRIKFKPSTTELKEAFEFGRDFSRTMFGEKELDYAPNNATETKEVLTGNGKTRYWKCLVCGEIFESPVCPEVCPVCGAGKEQFIEVEMDTFEKNDTNDNFVIIGNGAAGFYAAKTIREINSTASVKLLSSEEVSSYSRPNLSDLLNEEMNLDTFYLAKSSWYKENNIEELLGVTVTSIDKDAKKVILKDGTEIPYTKLILANGSHNFIPPFRIKNNDEEVTLNCENIHEFKGIYSIKDLKDTFDVKEEMKEAKKAVVIGAGPLGLEAAWEMKLAGLDVTVVEFLPNLMNNQLDQEGADIFKNQVSDCGITFITSEECTEIITKDSKLTSLKLKSGKTLDADILLVSTGIRSNIELAKETGIECNRGVIVNERMETSVKDIYACGDVAEFNGLVYGNWPAAIEMGKTAGANACEAEKAFENFTPSIILDALNTHVFSAGLIRFNDSSYEKISSKDESKGQYTKLFFKDNILVGGIIVGDISKAGQIIIAIDNKLSKAAALSNDLL

SEQ ID NO: 28195 - protein, 835 aa, Zinnia elegans
MNDNNSITKHQLDNGKYVRYTTEQVEALERVYAECPKPSSLRRQQLIRECPILSNIEPKQIKVWFQNRRCREKQRKESSRLQTVNKKLSAMNKLLMEENDRLQKQVSQLVCENGYMRQQMHTGSAATDASCESVVNTPQHSLRDATNPAGLLSIAEETLAEFLSKATGTAVDWVQMPGMKPGPDSVGIFAISQSCSGVAARACGLVSLEPTKIVEILKDRPSWFRDCRSLEVFTMFPAGNGGTIELVYMQTFAPTTLAPARDFWTLRYTTSLDNGSLVVCERSLSGSGAGPNPAAVAQFVRGEMLPSGYLIRPCEGGGSVIHIVDHLNLEAWSVPEVLRPLYESSKVVAQKMTIAALRYIRQIAQESSGEVVYGLGRQPAVLRTLSQRLSRGFNDAINGFSDDGWSLMNCDGVEDVIIAVNSTKNLNNSMNPSNSISYLGGILCAKASMLFQDVPPAVLVRFLREHRSEWADFNVDAYSAASVKANSCNTYPGMRPTRFTGSQIIMPLGHTIEHEEMLEVVRLEGHALGQEDPFTSRDIHLLQLCNGIDENAVGACSELVFAPIDEMFPDDAPLVPSGFRIIPLDPKSGGGKNALVTTHRTLDLTSSLDVTPANNHGSTDLSTCQTSRSVLTIAFQFPFENNLAESVATMARQYVRSVINSVQRVAMAISPSGLSPCVGPKPSPTSPEAVTLAQWICQSYTYHLGADLLSSGSLVGDSLLKDLWQHQDAILCCSLKSLPVFTFANQAGLDMLETTLVSLQDITLDKIFDDSGRKALVPEFAKIMQQGYAHLPGGICMSTMGRHITYEQAVAWKVLAADESTVHCLAFSFVNWSFV

SEQ ID NO: 28196 - protein, 649 aa, Lactobacillus johnsonii
MCGICAFFDPELKDKDCAIQGMMDTIKHRGPSSDGKYTNDKVALGFRRLSIIDLRGGSQPIFNEDKSRAIIFNGEIYNFKPLRKELIDAGHTFTTKADTEVLLHGYEEWGMDGLLKKVRGMFAFVIWDDNTKTLYGARDFFGIKPMYYSDQNGKLIVGSELKSFLAYPGFKKELNTEAVKPYLMNQYNDLKETFFKGVYRFPAGHWFEYKDGKMKTHQYWDAKYVENSLSFEETLDKINEDLKETVDLYRNADVPVGAFLSEGIDSSYLTSLLDPEDVFSVSFDDSTYNEASKAKALSDLHGWKFFADKVDADEAMRDFPEMQYHMDEPDANPSIIPLWYLCKLARKHVTVALSGEGADELFAGYVNYGMHTHNDVIKVFTAGLKKLPKKSRVRLAHKIKKMPNFPGKVHMYTNLAEPSEFYVGQSVIYDMDYPTIFTSKDANGILRDKYKNDLTVNGIYQEDFKKVKNIDEVKQMQYIDLHHFMLNDIEQKADKISMAHSLELRVPYLDKKIAELANSIPTKYLVNRHDTKYALRKASEKVLPEEWAQRPKLGFPTPIKQWLKEPRFYKQVRALFTEDFVDDIFDQKKIVKLLDDNYKGDGSARRQIWAIYTFLVWYKLFFVDYDETVKKYQHVQPEVAELIESGRLV

SEQ ID NO: 28197 - protein, 374 aa, Spinacia oleracea
MMQPLLTIPPPLPTTSLFDTSFLKHEDNIPSQFIWPDDEKPCSETPPELEVPPIDLGGFLSGDPVAVSKATTLANEACKWHGFFLIVNHDIYFELLVKAHEAMDYFFSQPFSQKQKALRKQGDHCGYASSFLGRFATKLPWKETLSFRYYDDDDDKSSKMVQNYISNLMGTDFQEFGRVYQEYCKAMSKLSLGIMELLGMSLGVGRNYFREFFKGNDSIIRLNYYPPCQKPELTLGTGPHCDPTSLTILHQDHVGGLEVFVDQKWYSIRPNQKAFVVNIGDTFMALSNGKYKSCLHRAVVNSKTPRKSVAFFLCPRGNKVIRPPIELGHPRVYPDFTWPLLLEFTQKHYRADTKTLDSFTKWLQKRSTEDERVK

SEQ ID NO: 28198 - protein, 410 aa, Exiguobacterium sibiricum
MSTFEALHIQEQWVKKLQKQGIKQPTPIQEQAIPHLLAGRDLIGKAQTGTGKTLAFLLPILEQIDLESKTVQALIVAPTRELARQIADETHKLIRNMEDIRALAVYGGQDVFKQIQRLGRMPQIIIGTPGRILDHVGRGTLDLSELKTLVLDEADQMLQIGFLPEIEDIIAAAPVDRQFVMLSATMPEKVEQLAKTYLRDPIEVQVEAEKVTVDAIEQFVVETTDRRKQATLRTMLDEMRPYAAIIFCRTQRRVSKLNEELQMQGYPTDELHGGLTQGKREKAMAKFYQGKTPFLIATDVASRGLDVTGVTHVFNYDLPDDAESYVHRIGRTGRAGNDGVAISIVTPRDGRSFRDMERELGVEVTPIVVELSDEMIRAQHDQSKGTKKPAEGRGNTRRSSNRRPGRDHHK

SEQ ID NO: 28199 - protein, 264 aa, Pseudomonas fluorescens
MRVALYQCPPLPLEPAANLQRLHQLAMEAKGADLLVVPEMFLTGYNIGKEAVATLAEVYNGEWAQQVGRIAKAAGLAILYGYPERTAEGQIYNAVQLIDSSGERLCNYRKTHLFGDLDRSMFSPGDGEFPIVELNGWKLGFLICYDLEFPENARRLALEGAELILVPTANMIPFDFIADVSVRSRAFENQCYVAYANYCGHEGDIHYCGQSSIAAPDGSRIAQAGLDEALIVGELDRQLMVDSRSANRYFNDRRPELYDALNKR

SEQ ID NO: 28200 - protein, 281 aa, Saccharomyces cerevisiae
MSEYQPSLFALNPMGFSPLDGSKPTNENVSASTSTAKPMVGQLIFDKFIKTEEDPIIKQDTPSNLDFDFALPQTATAPDAKTVLPIPELDAAVVESFFSSSTDSTPMFEYENLEDNSKEWTSLFDNDIPVTTDDVSLADKAIESTEEVSLVPSNLEVSTTSFLPTPVLEDAKLTQTRKVKKPNSVVKKSHHVGKDDESRLDHLGVVAYNRKQRSIPLSPIVPESSDPAALKRARNTEAARRSRARKLQRMKQLEDKVEELLSKNYHLENEVARLKKLVGER

SEQ ID NO: 28201 - protein, 475 aa, Bacillus cereus
MQQPTNEKLHRTMKSRHLFMIALGGVIGTGFFLGSGYTINQAGPGGAILSYLVGGFIMYLTMLCLGELTVAMPVSGSFQKYATKFIGPGTGFMIGWLYWLGWAVTVGLELTSIGLMMKRWFPNVDVWVWCLVFGVILYASNAISAKSYAELEFWFSSIKVITILAFVVLGGSALLGFISYDGKEAAPLFSNFVSNGGLFPNGLAAVLLTMITVNFSFQGTELIGIAAGESENPEKTIPRAIRNTVWRIMLFFILTMTILVGLISWKEAGVIESPFVVVFDKIGIPYAADIMNFVIITALLSVANSGLYAATRILWSLANEGMAPTSFQKVNKRGIPITALVVTIAVAGLSLFTSFLAEDTVYMYLLSIAGLSAVSSWIIIALSQLRFRSQYIKGGGKLEDLKYRTPLYPIVPILALITNSIVVISLAFIPEQRMALYCGIPFIIFCYIYYYISKKRQKPMKVEMEKTNETNNQTR

SEQ ID NO: 28202 - protein, 730 aa, Candida glabrata
MLHATVLPILLWLATLAYGFDRKEFLVDGNELPGFTKLKNTKHWTVPKMYAGHLPATRDNDTQYFFWKFENKKTKKNDETPLIIWLNGGPGCSSMAGALMEIGPFRLNKKAEVIKNDGSWHMRGSVLFLDQPVGTGFSYSKEDNEVSELDEVADNFMVFLQNYYATFPDDKDRELILAGESYAGQFIPYFTKAIIKFNEQQRDENSKINIKVMFIGNGWLDPKRQYLSYVPFSLEKGIIKKEDPAFKDILKQHETCQNYINSDHTGHSELSYPPCEAVLGKIISQDKTQCINVYKFDEYDSYPSCGLEWPVDTKFTKQFLTDKKVLAALHANDERSWIECRPDVKLENIKAKPAIELIPSLLESGIELILFNGNKDLICNTLGIDNVLKHLQWEGETGFTDEVQIFDWVYRDDLKSDKEKVAGTVKYERQLTLITIEDGSHMVSYDKALISRGILDMYYDDVLLVHRDGKDTLISSKDGDIDGYLEDDKSQDENKDNESEDESEDENDSDDESDGKEGDKQENKPDDSDDESDEEDDDEDEDDEDDDDDDDDDDGDDEDKKGDQNSHPSHGDMNGGLDNDLETGGEYYQDEDEEGSNFKAFFLILSLVSAFIIVAAFYISDYIKSRRHPILVDGDGRSRLNKSVTWASDIENGSFDIEDDDPEFGTEGMEDNMELEDVFSIDEEDEEQLEGVVPESTRKSKKGSKKKGKYFSVPNDDSAEDIELQDIERH

SEQ ID NO: 28203 - protein, 615 aa, Robiginitalea biformata
MAEENKKEEAVETAETQVQEAPAKQEAPAKQEDPQEFLENFDWDKYEEGIERVEDEKLAEFEQLVKENFVDTADEEVVKGTITHITDREAIIDINAKSEGVISLNEFRYNPDLQVGDTVDVLIDIREDKNGQLVLSHRKARTIKAWENVNEAHDKEEVVTGYVKCRTKGGMIVDVFGIEAFLPGSQIDVKPIRDYDQYVGKTMEFKVVKINQEFKNVVVSHKALIEADIEEQKKEIISQLEKGQVLEGVVKNITSYGVFIDLGGVDGLVHITDLSWSRINHPNEVVDLDQKLNVVILDFDDNKSRIQLGIKQLEKHPWDALGDEIKIGDKVKGKVVVIADYGAFLEVAEGVEGLIHVSEMSWSTHLRSAQDFVNVGDELEAVVLTLDREDRKMSLGLKQLTPDPWTDITSKYPVGSRHKGIVRNYTNFGVFVELEEGIDGLIYISDLSWTKKIKHPSEFVSVGDEMEVEVLELDVDGRKLSLGHKQTQENPWDKYEDEFGEGTTHKAAITEIVDKGAIIEFNEDITAFVPQRHMEKEDGKKLQRGEEAEFKIIEFNKDYKRVVASHTAIFKEEEQRNVRAARRKSAQADENKPTLGDANEQLQALKDKMEGKGKK

SEQ ID NO: 28204 - protein, 281 aa, Saccharomyces cerevisiae
MSEYQPSLFALNPMGFSPLDGSKSTNENVSASTSTAKPMVGQLIFDKFIKTEEDPIIKQDTPSNLDFDFALPQTATAPDAKTVLPIPELDAAVVESFFSSSTDSTPMFEYENLEDNSKEWTSLFDNDIPVTTDDVSLADKAIESTEEVSLVPSNLEVSTTSFLPTPVLEDAKLTQTRKVKKPNSVVKKSHHVGKDEESRLDHLGVVAYNRKQRSIPLSPIVPESSDPAALKRARNTEAARRSRARKLQRMKQLEDKVEELLSKNYHLENEVARLKKLVGER

SEQ ID NO: 28205 - protein, 475 aa, Neisseria meningitidis
MNYFPIFANLAGRPVLVVGGGAVAARKISLLLKAGAEVRVAAKHLNAELSALAAENKILWLAEEFRAEHIRTVFLIIAASSDQALNRRVFHLAESCQKPVNVVDDRDHCSFIFPSVIDRNPVQIAVSSSGSAPVLARLLRERLEALLPPSLGDMAEISGRWRDAVKGKLKSVTERRRFWEKQFNGRFAALVKNRQNTLAERELAGQLEQSRQNDQGGSVSLVGAGPGDAGLLTLKGLQEIQQADVVLYDALVSDGILSLVRRDAERIFVGKRARGERTPQEDTNALMVRLAREGRRVVRLKGGDPFVFGRGGEELETLARHQIPFSVVPGITAAVGATAYAGIPLTHRDYAQSAVFVTGHRKADAPDIEWQTLARSRQTLVIYMGALKAALIAERLQQHGRSPDTPAAVISQGTLPAQKTATGTLANLAELAETAPNPALIVIGEVVGLHEKLAWFGENGEGENRVGQTYPALGD

SEQ ID NO: 28206 - protein, 628 aa, Ostreococcus tauri
MSGAIASRARGVIPRRATKGSTPRSRARARASTRRDVLIAWPLLYAALNRIADAERVEASEGGKKRVVITGANSGIGLSAATTLALSGEWTVALACRTKEKSEQARAEMVSRGVAESDVECYECDLADLDSVRACARELRRNGSIDALALNAGVEFSGDPVVHRTAQGLEETVGVNHLGHFLLTNLLLEDLERSELAHPRIVVTASEVHDPASPGGSVGNGATLGSLEGFERDGKRFEMADGGNFDADKAYKDSKLMNMLFTYELERRLRERGSKITVNAFGPGLITRTGLFRHQNPLFVKVFDFATNEVFHVAETVDRGGDCLVYMLEEPSLEGVGGVYFNNGLAPGTPPTGHKFERTDSSVESNNQDEARKLWVISEDFVGLNSNYSRAATSSARAAFLQISPRRSSTRSRARAVSPGAFLWWSREKELRKRWKQLCEFAADEIPLASPLASTKSLIRWVGEYPLTAASALTAVAGGVSAAISAAVIPAVIGIAVVALPAVLFAAVGTAAVATLVGALVLLMALPALGFLSVFGGTIAAAASAKLLPLAILGSGLLFGAKAIEFGVKGDARAQRLKAGADAEPDSWAPRNANADADEDDENAEDYEETVKRNFDERLRALDGEKKK

SEQ ID NO: 28207 - protein, 719 aa, Arabidopsis thaliana
  misc_feature (80)..(80): Xaa can be any naturally occurring amino acid
  misc_feature (98)..(98): Xaa can be any naturally occurring amino acid
MEELDRSRAFARDVKRIVVKVGTAVVTGKGGRLALGRLGALCEQLAELNSDGFEVILVSSGAVGLGRQRLRYRQLVNSSXFADLQKPQTELDGKACAXGVGQSSLMAYYETMFDQLDVTAAQLLVNDSSFRDKDFRKQLNETVKSMLDLRVIPIFNENDAISTRRAPYQDSSGIFWDNDSLAALLALELKADLLILLSDVEGLYTGPPSDPNSKLIHTFVKEKHQDEITFGDKSRLGRGGMTAKVKAAVNAAYAGIPVIITSGYSAENIDKVLRGLRVGTLFHQDARLWAPITDSNARDMAVAARESSRKLQALSSEDRKKILLDIADALEANVTTIKAENELDVASAQEAGLEESMVARLVMTPGKISSLAASVRKLADMEDPIGRVLKKTEVADGLVLEKTSSPLGVLLIVFESRPDALVQIASLAIRSGNGLLLKGGKEARRSNAILHKVITDAIPETVGGKLIGLVTSREEIPDLLKLDDVIDLVIPRGSNKLVTQIKNTTKIPVLGHADGICHVYVDKACDTDMAKRIVSDAKLDYPAACNAMETLLVHKDLEQNAVLNELIFALQSNGVTLYGGPRASKILNIPEARSFNHEYCAKACTVEVVEDVYGAIDHIHRHGSAHTDCIVTEDHEVAELFLRQVDSAAVFHNASTRFSDGFRFGLGAEVGVSTGRIHARGPVGVEGLLTTRWIMRGKGQVVDGDNGIVYTHQDIPIQA

SEQ ID NO: 28208 - protein, 334 aa, Pantoea agglomerans
NGIAGSYAEYVPVVHIVGAPRLTSQRKGELLHHTLGDGEFCHFMRMSAPVSVAQASLTPENALAEIDRVIEEVMYSSRPGYLLLPSDVPALPVSTRAHALPARQPPFSPSSLEAFTAAAQTQLRGANRVSLLADFLADRFKVKKALEQWMEEVPLGTSTLLMGKGLFNEQQAHFAGTYSGAASAPSTKEAIEGADVVITVGVKFTDTITAGFYQQRPSGNASTSALFAARAIRSSITGRSKNGQRDAPPPPLNLAFRPGRLILLNTTHCRWSRDNSLGQYAFWQQIQDSLQPGDVLVAEQGTACFAAAALNLPQDLQFVVQPLWGSIGYTLAAA

SEQ ID NO: 28209 - protein, 201 aa, Unknown
  Synechococcus sp. CC9311
MRTGEIHRVTGETDVSVRLGLDGSGRCQASTGVPFLDHMLHQISSHGLIDLEITASGDTHIDDHHTNEDVGIAFGQALSKALGDRRGIYRFGHFVAPLDEALVQVVLDCSGRPHISWGLTIPTQKIGTYDTELVKEFFVAVVNNSGLTLHIRQLDGVNSHHIVEACFKAFSRALRMATEIDPRRSGLVPSSKGVLEQAGGS

SEQ ID NO: 28210 - protein, 1116 aa, Xanthomonas campestris
MNAVPALQADAEQSAVVADQLWYKDAIIYQVHVKSFFDSNDDGIGDFPGLISKLDYIAELGVDTIWLLPFYPSPRRDDGYDIAEYMAVHPDYGTIADFEQLVAQAHARGIRIVTELVINHTSDQHPWFQRARNAPAGSPERDFYVWSDTDQEYEGTRIIFCDTEKSNWTWDPVAGQYFWHRFYSHQPDLNFDNPAVLESVLEVMRFWLDRGVDGLRLDAVPYLIERSGTSNENLPETHAILRKIRATLDAEYPDRMLLAEANMWPEDTQQYFGQNADECHMAFHFPLMPRMYMAIAREDRFPITDIMRQTPEIPETCQWAIFLRNHDELTLEMVTDSERDYLWQTYASDRRARINLGIRRRLAPLLERDRRRIELMTSLLLTMPGTPVLYYGDEIGMGDNIHLGDRDGVRTPMQWSIDRNGGFSRADPAALVLPPVMDPLYGFQAVNVEAQIRDQHSLLTWTRRVLSVRKRYQAFGRGTLRFLYPGNRRMLAYLRCYQDETVLCVANLSHTLQAVELDLSEFEGRVPVDIIGGGSFPPIGRLTYLLTVPPFGFYAFQLVSEGTLPDWHVPSPVPLPDYRTLVLRSDTEESAALLPHLATLEGEILPAWLSARRWFSAKDQALKSVRISRRTPLPGDEPMSLLELDVELEDGHHECYMLPVGIVWEREHPSTLAEQLALARVRQGREVGYLTDAFALKPMVRGVIDALRHDAALDFHDGDDASQQGQVRFESTPALAALEIPDDPEIRWLSAEQSNSSLVVADKAVFKLLRHVATGANPEIEIGRRLTEMGYANAAPLLGSVSRVDAQGTITTIALLQGFIRNQGDAWRWTLDHLARSFDEYATAQTDEARNEAVAGYDAFAAVVGKRLAELHEALSRSTDDADFAPQRIDLPTANDVVGGVARQVEEMWETVHARLGATDDAAEREALESVLAERPQLDALLAKAPSVLAESLLTRVHGDFHLGQILVAFDDVVLIDFEGEPAKPLAERRAKASPLRDVAGFLRSLDYASEVSARGEEGTAARAGVGVDAHLDDFLVEFRRRSTQSFLDAYHAVLDASAHPWIAPAAFNAATLLFLVEKACYEVRYEAANRPGWLMVPIQGLRRILQRARAGAGDT

SEQ ID NO: 28211 - protein, 105 aa, Triticum aestivum
  misc_feature (96)..(96): Xaa can be any naturally occurring amino acid
MGANGALEGEEERPRADGEEERPRADGEEEEEGGATVFRGTNYSLPRTIAALALWLGGIHFNVLLILASLFLFPLRLAALVVALQLVFMFTPLNDXDKLGRKIGR

SEQ ID NO: 28212 - protein, 116 aa, Pleuricospora fimbriolata
FLSEACDLIFDAASRGDQLLIVGTKNIVADFVARAARRARCHYVNKKWLGGMLTNWSTTEKRLRKFRDLRMELKMGRLKRIPKNTRFKRQLAHLQAYFGGIQYMRGLPDIVIILDQ

SEQ ID NO: 28213 - protein, 159 aa, Pleuricospora fimbriolata
FLSEACDLIFDAASRGDQLLIVGTKNIVADFVARAARRARCHYVNKKWLGGMLTNWSTTEKRLRKFRDLRMELKMGRLNRIPKNTRFKRQLAHLQAYFGGIQYMRGLPDIVIILDQHKEYMALRECVTLGIPTICLIDTNSDPDLVDLPIPANDDNRFS

SEQ ID NO: 28214 - protein, 161 aa, Brassica napus
  misc_feature (11)..(11): Xaa can be any naturally occurring amino acid
  misc_feature (19)..(19): Xaa can be any naturally occurring amino acid
  misc_feature (21)..(21): Xaa can be any naturally occurring amino acid
  misc_feature (31)..(31): Xaa can be any naturally occurring amino acid
  misc_feature (36)..(36): Xaa can be any naturally occurring amino acid
  misc_feature (39)..(40): Xaa can be any naturally occurring amino acid
  misc_feature (42)..(42): Xaa can be any naturally occurring amino acid
  misc_feature (45)..(45): Xaa can be any naturally occurring amino acid
  misc_feature (48)..(48): Xaa can be any naturally occurring amino acid
  misc_feature (51)..(51): Xaa can be any naturally occurring amino acid
  misc_feature (55)..(55): Xaa can be any naturally occurring amino acid
  misc_feature (60)..(60): Xaa can be any naturally occurring amino acid
  misc_feature (63)..(63): Xaa can be any naturally occurring amino acid
  misc_feature (67)..(69): Xaa can be any naturally occurring amino acid
  misc_feature (75)..(76): Xaa can be any naturally occurring amino acid
  misc_feature (88)..(89): Xaa can be any naturally occurring amino acid
  misc_feature (91)..(93): Xaa can be any naturally occurring amino acid
  misc_feature (95)..(96): Xaa can be any naturally occurring amino acid
  misc_feature (100)..(102): Xaa can be any naturally occurring amino acid
  misc_feature (105)..(107): Xaa can be any naturally occurring amino acid
  misc_feature (115)..(115): Xaa can be any naturally occurring amino acid
  misc_feature (119)..(120): Xaa can be any naturally occurring amino acid
  misc_feature (139)..(139): Xaa can be any naturally occurring amino acid
  misc_feature (147)..(148): Xaa can be any naturally occurring amino acid
  misc_feature (151)..(151): Xaa can be any naturally occurring amino acid
  misc_feature (153)..(153): Xaa can be any naturally occurring amino acid
  misc_feature (155)..(156): Xaa can be any naturally occurring amino acid
SEKKKKKKSVXASSMLSSXAXVTSPAHATMXAPFTXLKXXAXFPXTRXANXDITXIASNXGRXSCMXXXPPVGKXXVETLSYLPDLTXXEXXXEXXYLLXXXWIXXXEVELEHGXVYRXXGSTPVYYDGRYWTMWKLPXFGCTDSAXXLKXAXNXXGERDI

SEQ ID NO: 28215 - protein, 577 aa, Aspergillus nidulans
MMDQHPLPFLTHSPIDPGSIDGEKATAYARGVLNRLNAALAASDTEALENCFYSDQASWKDQLALTWHLRTFRCHNTIAASFLDTARLRGLSSGITIDGEAVFLSATPALVCPESPIAYSPSLQDAMNFETDVFIIGAGNAAIALSACLKALGVESVMADRNAHPGDNWARRYDCMRFHVPTAFCDLPYMYRATVYDEELRSPHLLTRQDLTSQVRRYVNSFNLNTLHLAEIQWTEYDELAKKWTIAFQTPAGQCKATSSHLVLATGIGSLKPNIPYIAEPHIYKGISIHSAEYKNAKLLKEQGVKSVVLIGSANTAFDVLENGHSAGLNATMVARSPTYIVPLEYVYHQASLGTYDTESMQPIISSSHCQHLWTDSCVVDCFPRSHRLNWNDTPQSRQPGPCSQQSRTNGSFRESTCLDTDAIIWCTGFADSNVVTTATEILGGKSDVTVANTKIDDQTGRAHVLTPGGIASHLDTTWGVDEEGEIRGMWKRHSHVESIWIMGGYTQQHWWYSRILALQIKAALQVKVGSKDNNSALKGIVSSTLRSIASSCSGRDYYGLSSQGRDKDAISSNTAR

SEQ ID NO: 28216 - protein, 849 aa, Zinnia elegans
MAMAVEHQASTKRSVVITASQNIKLDNGKYVRYTTEQVEALERVYAECPKPSSLRRQQLIRECPILSNIEPKQIKVWFQNRRCREKQRKESSRLQTVNKKLSAMNKLLMEENDRLQKQVSQLVCENGYMRQQLHTGSAATDASCESVLTTPQQSLRDANNPAGLLSIAEETLAEFLSKATGTAVDWVQMPGMKPGPDSVGIFAISQSCSGVAARACGLVSLEPTKIVEILKDRPSWFRDCRNLEVFTMFPAGNGGTIELVYTQIFAPTTLAPARDFWTLRYTTTLENGSLVVCERSLSGSGAGPNPAAASQFVRGEMLPSGYLIRPCEGGGSIVHIVDHLNLEAWSVPEVLRPLYESSKVVAQKMTIAALRYIRQIAQESSGEVVYGVGRQPAVLRTLSQRLSRGFNDAVNGFSDDGWSLMNCDGAEDVIVAVNSTKNLNNSMNSSTSPPYLGGIICAKASMLFENVPPGVLVRFLREHRSEWADFNVDAYSAASVKANPYNTYPGMRPTRFTGSQIIMPLGHTIEHEEMLEVVRLEGQALGQEDPFMSRDIHLLQLCNGIDENSVGACSELIFAPIDEMFPDDAPLIPSGFRIIPLDPKSVDAKNALVTTHRTTLDLTSSLDVTPTPNHGSTDVSTCQTTRSVLTITFQFPFENSLAESVATMARQYVRSVINSVQRVAMAISPSGLSPCVGPKPSPGSPEALTLAQWICQSYMYHLGADLLSSGSVVGESLLKDLWQHQDAILCCSLKSQPVFIFANQSGLDMLETTLVSLQDITLDKMFDDSGRKALVPEFAKIMQQGYAHLPGGICMSTMGRHVTYEQAVAWKVLAADESTVHCLAFSFVNWSFL

SEQ ID NO: 28217 - protein, 222 aa, Zea mays
MGTPETSREPCPDRILDDVGGAFGMGAVGGSAYHFIKGIYNSPNGMRLSGGAQTVRMNAPRVGGSFAVWGGLFSTFDCAMVYARQKEDPWNSIVAGAATGGFLSMRQGMGAAGRSALMGGILLALIEGAGLMLNRVLANPPLPADDPNLTAAMGGNPFPGLPQAPPVVAPPEAATSSGVGGLFGGLFGRKEEDKKPSAVGGKSEILESFDTPSSPIPSFEYK

SEQ ID NO: 28218 - protein, 339 aa, Zingiber officinale
MATRKAFFVILIALLISILVAVPTRAQSIGVCYGMLGNNLPQPTAVVNLYRSNGIGRMRLYDPNQTALRALRNSNIQLIMDVPRTELQSLASNPSAAANWVQANVVAFWPSVSFRYIAVGNELIPGDAAAQYVLPAMRNVQTALSSAGLQNQIKVSTAVDTGVLGQSFPPSNGAFSAAAQAYLAPILQFLRGNNAPLLVNVYPYFSYADNPSQISLAYALFTAGGVVVQDGQFGYQNLFDAQVDAVYAALEKAGSGSVVVVVSESGWPSAGGFAASVSNAQTYNQNLIRHVGRGTPRRAGRAIEAYLFAMFNENQKSPGVEQNFGLFYPNGQPVYPISL

SEQ ID NO: 28219 - protein, 850 aa, Pseudomonas putida
MKATVSSGQRERLVIVGNGMVGHHCVEQLVSRGALQRFEVRVFGEERQRAYDRVHLSEYFGGSCAETLALCEHDFYNANGVHLHLGEAVLEIDRERCEVVTAEGRYGYEQLVLATGSYPFVPPIEGSSGNARLVYRTLDDLDGIRAAAAGARRGVVVGGGLLGLEAANALKSLGLEAHVVEFAPRLMPVQLDGEGGAALKAQIEALGVGVHLSRATQSINDGESYRYRMNFDGGEHLETDLVVFSAGIRPQDALGRACGLEIAARGGVVIDNHCRSSDPRIFAIGECASWNGSVFGLVAPGYGMARNLAALLMGEAAVAFTGADMSTKLKLLGVDVGSIGDAHGATPGARSYRFIDEANSAYRRLVVDASGKHVLGAVLVGDNSYYDTLLQYAQNGIALPADPAALILPQGGGAPALGADALPDRATICSCHNVSKGAVCAAIDSGCSDLAAVKGCTKAASGCGGCAALLKQVFEHELTARGVAVDKSLCEHFAYTRQELYGLVRVEGIRTFGELLERHGKGHVGCDICKPAVGNILASCWNQPIMDPALVPLQDTNDTFMANMQKNGTYSVVPRIPGGEITPDKLIVIGQVAKKYDLYTKITGGQRIDLFGAQLHELPLIWGELIEAGFETGHAYGKSTRTVKSCVGSTWCRYGVQDSVGMALRLEDRYKGLRSPHKLKFAVSGCTRECAEAQSKDIGVIATDKGWNLYVCGNGGMRPRHAELFATDLDDETLVRLIDRVLMFYIRTADKLQRTSVWRESLDGGLDYLKQVIIDDSLGLASELEAQMQHVVDQYECEWANALNDPEKLKRFRTFVNDRRADPDMHFVREREQRRPAAPLHLIPTVEEAV

SEQ ID NO: 28220 - protein, 310 aa, Streptomyces coelicolor
MAVVTMRELLESGVHFGHQTRRWNPKMKRFIFTERNGIYIIDLLQSLSYIDRAYEFVKETVAHGGTVMFVGTKKQAQEAIAEQATRVGMPYVNQRWLGGMLTNFSTVYKRLQRLKELEQIDFEDVAASGLTKKELLVLSREKAKLEKTLGGIREMSKVPSAVWIVDTKKEHIAVGEARKLNIPVVAILDTNCDPDEVDHKIPGNDDAIRSVTLLTRVIADAVAEGLIARSGAAGGAKGDKAAGEPLAAWERDLLEGEKAEKKDDAEAAEKPAEAPAAEAPAAEAAEAPAAEAAPAEEPAAEAPAADAEQA

SEQ ID NO: 28221 - protein, 1338 aa, Pseudomonas putida
MANSEVRSVCPYCGVGCGIVMSVADGKVGKISGDKQHPSNFGRLCTKGLTAHLPLSAAGRMADAYVRQQRSQPPVRTSMDQAITDTAMRLRGIIDQHGADAVALYVSGQMSLEAQYLANKLAKGFIRTRHIESNSRLCMASAGSGYKLSLGADGPPGSYQDFEHADVFLVIGANMADCHPILFLRLLDRVKAGARLIVVDPRRSATADKADLFLQVRPGSDMALLNGFLHLLQRNGHTNPDFIARHTEGWDELPPFLDDYTPERVAAITGLAEADIIQAADWIGSASNWMSCWTMGLNQSIHGTWHSNAICNLHLATGAICRPGSGPFSLTGQPNAMGGREMGYMGPGLPGQRSALVATDRAFVEQQWQLAPGSLRSEGGEGTVALFEQMKAGEVKACWIICSNPVASVANRQQVIDGLREAELVITQDAFLDTETNRYADILLPAALWAEGEGVMINSERNLTLMPRAVQPPGQSLPDWQIIARVACAMGYADAFDYPDAEAVYEEIRRFHNPLTGYDLRGIGYAELRTQPRQWPCAPGREQARSPLRYLNDGSSQALLLDAQGQRPALAFPTASGKARFFARPWLPAPELPNDDYPMVLNTGRVQHQWHTLTKTGKVPALNKLEPGPFVEIHPEDAARLGVAEKDQVAIRSRRGQAVLPARISDRVMPGNCFAPFHWNDLIGEQLAINAVTCDAVDPLSLQPAFKHCAVALERVASERIDALDLNTATSEPARMPTATLSRLLGLDTLPTPVLAEEERHYLQGFLLGLDQARAEGVPALPASAPLAANRRLFVDGLLAGLFAQPATAPPAALTVPLHQVLWASQTGNGELLAERCAERLRGAGLSVQLRCMEAVSPSQLQGAASVVLIASTFGDGDAPDSAAAFWQALQGEGGAHCAELPYAVLALGDSSYDQFCGFGRKLDLRLAELGGRRLLQRVDCEPDFDEAFAGWLEALLAELGSATAPLPASDPAPVAAYSKQQPWAATLRENRLLNGPGASKETRQLVFDLSGSGFTYAAGDALGVWPRNCPALVDELLALTQLDGQALVELKGQPAMPLAEALQAHLEIAKVSPQQLQAFAGNAPDLQRLLQPACKAELQDWLWGRQLTDVLRAFPQQLPLAHWLELLKPLQPRLYSISSSPLAHPEQVHLTVSTVRYGKRKGVCSSFLADRAQALKVAIFPQVSKHFRLPEDDNVPVIMVGPGTGIAPFRAFLEEREARGAKGGNWLFFGEQYAATDFYYREQLQAWQAGGHLRLDTAFSRDQAEKIYVQQRLREQGAQVWQWLEAGAYFYVCGDAQRMAKDVDAALREVIAVHGKVDADAYVETLNKAKRYRRDVY

SEQ ID NO: 28222 - protein, 125 aa, Brassica napus
GPRTRPEARKKLVRAQTEREILQSLDHPFLPTLYSHFETENHSCLVMEFCPGGDLHSLRQKQPGKYFPEHAARFYVAEVLLAMEYLHMLGIIYRDLKPENVLVREDGHIMLSNFDLSLRSSISPN

SEQ ID NO: 28223 - protein, 331 aa, Bacillus anthracis
MNLAKFPRKKYTESYTPIEKLNNFSEALGGPTIYFKRDDLLGLTAGGNKTRKLEFLVADAQAKGADTLITAGGIQSNHCRLTLAAAVKEKMKCILVLEEGLEPEEKPDFNGNYFLYHLLGAENVIVVPNGADLMEEMHKAAKEVSEKGNTPYVIPVGGSNPTGAMGYVACAQEIIAQSFDQGIDFSSVVCVSGSGGMHAGLITGFAGTQSNIPVIGINVSRGKAEQEEKVAKLVDETSAHVGIPNFIPREAVTCFDEYVGPGYALPTPEMVEAVQLLAKTEGILLDPVYTGKAVAGLIDLIRKGTFNKEDNILFVHSGGSPALYANTSLFA

SEQ ID NO: 28224 - protein, 665 aa, Yarrowia lipolytica
MTHQRDNDADRDNSGNPREEYAEDNSPDSPDSPDQPPSQRRSERGRQTETIPIIVRQEENWGPDFWRDPPGTHLMRDTLKNRAMFYSLARQGFYPPMCRYERRKMQHLVRPPTRGLPYSKERLAALNEALRKLEDPNAVFDPDFEADLIAEYEGDLQAQREAVIRAEQSARRRARLEVRREAQQAELAARRARQEAHRQSSLGDAAPRSAYFDQSALDAMSRVAAGSSAEAEESADERPESSGRPRKRRKIAIDDEDSDERPHTWSGTGWDDHQKIAPDLQESGGFPDQDGDDVFLDASDEFDDSPVSAPVVSPRDFENLYEDDSSDEPIASSSRDVPRPSAPFNQTTHVGSDVSQSPRRSVPNYQPRPVFVKESAPDPDGPSDSSSGEESDDNNKPNRDKGKAPASSSDDISASESDPSYSPPSKAPATTLEQQKVASLDRSGLAEESVPNPDGPSSSRSGEENRTHDTENNGSVVPNSSIPQVHDADERSNAASQPEQPTPYLPGSDVADDPRGSEASLVRGTPTDQNTANNASIRLTRELESLTQQPTKPKPNTGNNTRRQGTGGKGLGKGGAKRHRKVIKDVIQGVTKPSLRRIARRGGVKRISTQIYEEGRTMLKIFLENLIKDAVAYTEHAKRKTVTSLDVVYAAKRRGRPIYGYGWSR

SEQ ID NO: 28225 - protein, 105 aa, Geobacillus kaustophilus
MAIVNATDQTFAAETKDGLTLVDFWAPWCGPCRMIAPVLEELDREMGDKVKIVKVNVDENQETASKFGVMSIPTLLVFKNGELVDKAIGYQPKEALVQLVGKHVS

SEQ ID NO: 28226 - protein, 181 aa, Glycine max
MAYSMLSSAAVVTSPAQATMVAPFTGLKSSSAFPVTRKANNDITSIVSNGGRVSCMKVWPPVGKKKFETLSYLPDLTEVELGKEVDYLLRNKWIPCVEFELEHGFVYREHGSTPGYYDGRYWTMWKLPLFGCTDSAQVLKEVQECKTEYPNAFIRIIGFDNNRQVQCISFIAYKPPSFTGA

SEQ ID NO: 28227 - protein, 322 aa, Yarrowia lipolytica
MSLNRSKFTEYKQTARNFWAGKPRFTEENYPSLDGKTFLITGGHSGVGLESTKLLISKGAKVVIVGRSKDKAQEVLAELPSQQYEFVEANLADLTTIKAAGEYIQNNYPELQGVILNAGVMIPPYSKTPQGHELQWGTNVVGHHALMKYLGPILIHTAKSSPKNSVRVIWVSSSATVVSPYEGGINFDDINLDKVDSPNDHILYSQSKIGNAYQAYLWSKHHPGSGVVSVSVDPGNLRSNLQRHGNGVLFYVLDYFLYPAKFGAYTELSALLNTEVRDTDHLIPWGQVGHLRNDVDYCRRGDKGEALWQQLDSDVKDFVAKL

SEQ ID NO: 28228 - protein, 178 aa, Triticum aestivum
  misc_feature (110)..(110): Xaa can be any naturally occurring amino acid
  misc_feature (130)..(130): Xaa can be any naturally occurring amino acid
  misc_feature (140)..(140): Xaa can be any naturally occurring amino acid
  misc_feature (147)..(148): Xaa can be any naturally occurring amino acid
  misc_feature (155)..(155): Xaa can be any naturally occurring amino acid
MGSEAGGGAAAIDLLRSAAPFLPDADLLLTPGTGLVLVDLVNGFCTVGAGNLAPVTPNKQIEKMVEESTRLAKVFCQRNWPVFAFLDTHHPDKPEPPFPPHCIIGSGEEXFVPTLGVVENDSNVTMRRKXCIDGYLAQFXKDGQCFXXWVQSSSXNVLGVGISTRVWACSQPSRNGEA

SEQ ID NO: 28229 - protein, 167 aa, Medicago truncatula
MKVTSDMIHKMHQEAEKVWIHELVKVIKETNEPFLNLIYDSDPLEKIFWDNVVLVGDAAHPITPHCIGSTNMSILDAAVLGKCLEKWGPEKVESALEEYQFIRLPVTSNQVLYARCLGRLKQGLVLPDRHPLDPKLANPEDYQDLLLRNTPFFYDVPSLFALILSSI

SEQ ID NO: 28230 - protein, 116 aa, Yarrowia lipolytica
MSMQTTLAKTEYLPLKEVSRPIPPVLDEEKISKMIETLKAHEHKSSESDESALPPPDVLVIRRNGKTHYFAFGGCHRFQAYDRLNTDKILCRLIPCTVDQLKLYLGSSAETLLERI

SEQ ID NO: 28231 - protein, 109 aa, Medicago truncatula
MDREGRKPKAVIVGGSIAGISSANALTLAGWDVIVLEKTISPPTGNPTGAGLALNPLSQKIIHSWISHPQLIQNITVPLTFDQNQVTDSEKKVNWTLIRDESFNLTAVH

SEQ ID NO: 28232 - protein, 233 aa, Papaver somniferum
MAGSGSEEVKILGGWPSPFVMRPRIALNIKSVKYYLLEETFGSKSELLLKSNPIYKKMPVLIHGDKPICESMIIVQYIDDVWASAGHSIIPSDPYDASIARFWATYIDDKFFPSLMGIAKSKDAEEKKAAIEQAIAAFGILEEAYQKTSKGKDFFGGEKIGYVDIAFGCYVGWIRVTEKMNGIKLFDEEKVPGLTKWAEKFCADETVKSVMPETDALMEFAKKIFGSKPPPSN

SEQ ID NO: 28233 - protein, 377 aa, Myxococcus xanthus
MSSISTGRTALRSARRVVVKIGTNALTNATGRFNRQHFDALGQDLLWAAQGRELVVVSSGAIALGVERLGLPSRPRDIPGKQACAAVGQSRLVQAYEEAFAAHGKAVAQVLLTHEDVQERRRYLNVKHTLERLLTAGVVPVINENDTVSVDELKFGDNDTLAGLVAGVVDADALVLLSDVEGLYTGDPRRDAGAELLATVMQVTPEVLALATGTSSGVGTGGMSTKVRAAARASDSGIHCVITSGAVPGRLRAVLEGADVGTHFEPTGSRRSARAAWIAHALRARGTLTVDAGAREAIVTGKRSLLPSGVRGVEGDFGRGDPVDLVDAEGAVFARGLAAYDANELRRIAGHRTADIEAVLGYRYLDEAVHRDDLAVL

SEQ ID NO: 28234 - protein, 428 aa, Medicago truncatula
MVGEGRKPKAVIVGGSIGGISSAHALILAGWDVLVLEKTTSPPTGSPTGAGLGLNSLSQQIIQSWISKPPQFLHNTTHPLTIDQNLVTDSEKKVNRTLTRDESLNFRAAHWGDLHGVLYESLPPQIFLWGHIFLSFHVANEKGPVIVKAKVVKTGEVIEIVGDLLVAADGCLSSIRRKYLPDFKLRYSGYCAWRGVLDFSEIENSETIKGIKKAYPDLGKCLYFDLASGTHSVLYELPNKKLNWIWYVNQPEPEVKGTSVTTKVTSDMIQKMHQEAEKIWIPELAKVMKETKEPFLNFIYDSDPLEKIFWDNVVLVGEAAHPTTPHYLRSTNMTILDAAVLGKCIEKWGTEMLESALEEYQLTRLPVTSKQVLHARRLGRIKQGLVLPDRDPFDPKSARQEECQEIILTNTPFFNDAPLSFASVTSSI

SEQ ID NO: 28235 - protein, 196 aa, Caulobacter crescentus
MARTAEVVRETKETQIRVWIDLDGTGVSTISTGIGFYDHMLESFARHGGFDLKVETKGDLHIDMHHTVEDTGIVLGQAIHKALDGFKGIRRFGSAYIPMDETLTRCAIDLSNRPYLIWKVEFKRPKVGEMDTELFKEFHHAFAMNSGACIHLETLYGDNTHHVAESGFKALARALRQAVEIDPKTGGQAPSTKGVL

SEQ ID NO: 28236 - protein, 161 aa, Unknown
  marine gamma proteobacterium HTCC2207
MSNDQSIYDFTVADSSGNPVSLEDYRGKVMLIVNTASKCGFTPQYTQLQELYDQYSDRNFVVLALPCNQFGGQEPGSNAEVQEFCQMNFGLSFPVMGKIDVNGKDQHALYTHLKSQAGGMFNSKIKWNFTKFLVDREGQVIERYAPIRKPKDIAADIEKLL

SEQ ID NO: 28237 - protein, 319 aa, Geobacter sulfurreducens
MKKIGILTSGGDCSGMNAAIRAAVRTAIRMNIEVVGFRKGYLGLMKGDAIPLDTKAVSGILHRGGTFLQSARSPEFKTPEGQRTALNNLKALGVEGMVVMGGDGSLTGALALNRLGLPVVGIPASIDNDIPFTDMALGVDTALNNIIYAVDCIKDTASSHARAFVIEVMGRHSGYLASISAIATGAEYALVPEREYDLAEICQQLRARYEEGRDNAIIILAEGAGHGHEIANSIKDAIGFETRVTVLGHYQRGGAPTVFDRLLASRLGKKSVELLVTGTWGVMVGLSCNAILATPLEDVIKGEKRPQDEVLRLAEVLGV

SEQ ID NO: 28238 - protein, 315 aa, Oryza sativa
MGTLVGHVAPGAGFLLVGLWHLYNHIRLFLLRPTAYVAPVWFPVRRARYLELALVIAGAVASILMELVVGPARHQPFDADGTVPSDHLHNFEHASISLALLVYAAAAAALDVARVPHGRAVSQLVAAVAFAQQLMLFHLHSADHAGVEGQYHLLLQGVVAVTLAATVLGVAAPRSFAVSLVRSASLVLQGVWFLAMGVMMWTPALLPKGCFLSREDGHDVARCRADDGGDALARAKALVNLEFSWYLSGTVVLVVALYLRLCRLYPEEPRYMPLVRGDCRDDDEDGGGDGDDNDVEAGKGGAGHVLREPLEIARP

SEQ ID NO: 28239 - protein, 281 aa, Saccharomyces cerevisiae
MSEYQPSLFALNPMGFSPLDGSKSTNENVSASTSTAKPMVGQLIFDKFIKTEEDPIIKQDTPSNLDFDFALPQTATAPDAKAVLPIPELDAAVVESFFSSSTDSTPMFEYENLEDNSKEWTSLFANDIPVTTDDVSLADKAIESTEEVSLVPSNLEVSTTSFLPTPVLEDAKLTQTRKVKKPNSVVKKSHHVGKDDESRLDHLGVVAYNRKQRSIPLSPIVPESSDPAALKRARNTEAARRSRARKLQRMKQLEDKVEELLSKNYHLENEVARLKKLVGER

SEQ ID NO: 28240 - protein, 233 aa, Papaver somniferum
MAGSGSEEVKILGGWPSPFVMRPRIALNIKSVKYYLLEETFGSKSELLLKSNPIYKKIPVMIHGDKPICESMIIVQYIDDVWASAGHSIIPSDPYDASIARFWATYIDDKFFPSLMGIAKSKDAEEKKAAIEQAIAAFGILEEAYQKTSKGKDFFGEEKIGYIDIAFGCYIGWIRVTEKMNGIKLFDETKVPGLTKWAEKFCADETVKSVMPETDALMEFAKKIFGSKPPPSN

SEQ ID NO: 28241 - protein, 213 aa, Desulfovibrio desulfuricans
MLRHFPGIILAAALIIIPLTTLYATAKLPPGKLPDSPPEGLAYATFAGGCFWCMEPPFDRTPGVLETISGYTGGHTEHPSYEQVSAGGTGHYEALRVVFDPRQVSYDTLLTIFWSNIDPYDASGQFCDRGDQYRSAVFWHDDGQKEAALRSVAHGLQDGSLDKAPATEILPAQDFWQAEDYHQDYYRKNPVRYKFYRFSCGRDQRLEELHDKR

SEQ ID NO: 28242 - protein, 426 aa, Arabidopsis thaliana
MVRDIEDEIRDEKNPRPLDEDDIALLKTYGLGPYSAPIKKVEKEIKDLAKKINDLCGIKESDTGLAPPSQWDLVSDKQMMQEEQPLQVARCTKIISPNTEDAKYVINVKQIAKFVVGLGDKVSPTDIEEGMRVGVDRNKYQIQIPLPPKIDPSVTMMTVEEKPDVTYNDVGGCKEQIEKMREVVELPMLHPEKFVKLGIDPPKGVLCYGPPGTGKTLLARAVANRTDACFIRVIGSELVQKYVGEGARMVRELFQMARSKKACIVFFDEVDAIGGARFDDGVGGDNEVQRTMLEIVNQLDGFDARGNIKVLMATNRPDTLDPALLRSGRLDRKVEFGLPDLESRTQIFKIHTRTMNCERDIRFELLARLCPNSTGADIRSVCTEAGMYAIRARRKTVTEKDFLDAVNKVIKGYQKFSATPKYMVYN

SEQ ID NO: 28243 - protein, 607 aa, Saccharophagus degradans
MSFKRFLSTASLVCTALFASANGFAIDYVQNALARENISLNGQWNRIIDPYENGYYNHRYQPHTTEGYFKNAKMKTPSDLIEYNFATAEKIRVPGDWNTQEEQLFLYEGTVWYQKDFALTKQADKRYIVHFGAVNYQAMVYINGVKVGSHEGGFTSFQFDITDYVKRGENSIVVKADNRRERNQIPTVNTDWWNYGGITRSVAILELPATYVEDYTVQLSGSDATAIVAKVALAGSNVKQGGSVKVSIPELNIQEVITLNKKGEGQITAKANPQLWTPEAPKLYDVTIAFNGELIRDRIGFRTIAVDGEDILLNGKSVFLRGISIHEESPLHDGRAWNEDDARTLLRWAKELGCNFVRLAHYPHNETMVKMADEMGLLVWSEIPVYWTVMFEDKAVYAKAEKQLTEMITHDKNRASIILWSMANETPSHKARLTFITKLAKKARSLDDTRLITAAMDTQGNTANGKIIDDPLVAAMDVIGVNSYCGWYGGTPESCGNILWESKYNKPVIVSEFGAGALQGLHGDKDERWTEEYQASVYEHNIAMLEKMTALRGVTPWILKDFRSPRRPLPDIQDFWNRKGLLSEQGIRKKAWYLLNAYYSKKEESSN

SEQ ID NO: 28244 - protein, 90 aa, Kluyveromyces lactis
PAFVNKLWSMVNDKSNEKFIHWSTSGESIVVPNRERFVQEVLKKYFKHSNFASFVRQLNMYGWHKVQDVKSGSMLSNNDSRWEFENERHA

SEQ ID NO: 28245 - protein, 224 aa, Mesembryanthemum crystallinum
MGEEVILLDFWPSMFGMRLRIALAEKGVKHERKEEDLLIGKSPLLLQLNPVHKKIPVLVHNGKPINESMIAVQYIDEVWNEKSPSLLPSDPYQRAQARFWADFIDKKLYDECRKIYTTKEAEIGEETYKGFLEIIKVLEAEVGEKSYFGGDTFGFVDVALIPFYSWFYALEMLGKFNIETECPKLIAWAKRCMERESVSKSLPDRHKIYDFITLQLRKALGVDQ

SEQ ID NO: 28246 - protein, 90 aa, Kluyveromyces lactis
PAFVNKLWSMVNDKSNEKFIHWSTSGESIVVPNRERFVQEVLAKYFKHSNFASFVRQLNMYGWHKVQDVKSGSMLSNNDSRWEFENERHA

SEQ ID NO: 28247 - protein, 464 aa, Unknown
  Mycobacterium sp. MCS
MRIAQHVSELIGNTPLVQLNSVVPEGAGTVAAKIEYLNPGGSSKDRIAVKMIDAAEASGELKPGGTLVEPTSGNTGVGLALVAQQRGYKCIFVCPDKVSEDKRNVLRAYGADVVVCPTAVAPDDPDSYYSVSNRLVTEIEGAWKPDQYSNPMGPESHYETTGPEIWRDTDGKVTHFVAGVGTGGTITGAGRYLKEVSGGKVRVIGADPEGSVYSGGTGRPYLVEGVGEDFWPSAYDPAVPDEIIAVSDADSFDMTRRLAREEGLLVGGSCGMAVVAAIEVAQKAGPDALVVVLLPDGGRGYLSKIFNDSWMSSYGFLRNRLDGSIEQPTVGDVLRGKSGELPDLVHTHPSETVRDAIGILREYGVSQMPVVGAEPPVMAGEVAGSVSERELLSAVFEGRAKLADAVAEHMSPPMPLIGAGELVSTAAKTLRECDALMVVEEGKPVGVVTRHDLLGFLSDGSTRR

SEQ ID NO: 28248 - protein, 229 aa, Oryza sativa
MMGATSPSGLELTMAVPGLSSSGSEGAGCNNNNAGGGCNMRDLDINQPASGGEEEEFPMGSVEEDEEERGVGGPHRPKKLRLSKEQSRLLEESFRLNHTLTPKQKEALAIKLKLRPRQVEVWFQNRRARTKLKQTEMECEYLKRCFGSLTEENRRLQREVEELRAMRVAPPTVLSPHTRQPLPASALTMCPRCERITAATGPPAVRPPPSSAAAAAPSPFHPRRPSAAF

SEQ ID NO: 28249 - protein, 430 aa, Sorghum bicolor
MGLSTAYSPAGSGLVPAPLARAARRRSVQVRRPRLATVRCSVVDAAKQVQDGVATAEAPASGNECFGVFCNIYDLKAEDKTKSWKKLVTIAVSGAAGMISNHLLFKLASGEVFGQDQPIALKLLGSERSFQALEGVRMELEDSLYPLLREVSIGIGPYEVFQDVDWALLIGAKPRGPGMERAALLDINGQIFADQGKALNAVASRNVKVLVVGNPCNTNALICLKNTPNIPAKNFHALTRLDENRAKCQIALKAGVFYDKVSNVTIWGNHSTTQVPDFLNAKIDGRPVKEIIQDTKWLEEEFTMTVQKRGGLLIQKWGRSSAASTAVSILDAIKSLVTPTPEGEWFSTGVYTTGNPYGIAEDIVFSMPCRSKGDGDYELATDVSMDDFLWERIKKSEAELLAEKKCVAHLTGEGDAFCDLPEDTMLPGEN

SEQ ID NO: 28250 - protein, 415 aa, Clostridium perfringens
MNNELIIKGKKAKEASYTLSFASTNEKNNGLLKISESLIKRCDEILEENKKDIEKAIEKGTSNAMLDRLKLDEERVKSIANAVADVIKLDDPIGEVTSMFKRPNGLRIGVQRVPLGVVGIIYEARPNVTADAAALCLKTGNAVILRGGSEAINSNLKIVDIISDALKEAGLPEGSVQILEDTSRETATDFMRLNDYLDVLIPRGGAGLIKAVVNNATVPVIETGVGNCHIYIDDEADINMGVDIIVNAKTSRPAVCNAAEKLLVNEKIAEEFLPVAIKALKEKGVEIRGCEKTKVIVNDINLATEEDWGKEYLDYILGVKIVKDLDEAISHINKYGTKHSESIVTKNYFNSEKFLQRVDAAAVYVNASTRFTDGGEFGFGAEIGISTQKLHARGPMGLKELTTNKYIIYGNGQVR

SEQ ID NO: 28251 - protein, 550 aa, Salmonella enterica
MFCVQCEQTIRTPAGNGCSYAQGMCGKTAETSDLQDLLIAALQGLSAWAVKAREYGIINHDVDNFAPRAFFSTLTNVNFDSPRIVGYAREAIAMREALKAQCLSVDANAHCDNPMADLQLVSDDLGELQRQAAEFTPNKDKAAIGENILGLRLLCLYGLKGAAAYMEHAHVLGQYDNDIYAQYHKIMAWLGTWPADMNALLECAMEIGQMNFKVMSILDAGETTKYGHPTPTQVNVKATEGKCILISGHDLKDLYNLLEQTEGTGVNVYTHGEMLPAHGYPELRKFKHLVGNYGSGWQNQQVEFARFPGPIVMTSNCIIDPTVGSYDDRIWTRSIVGWPGVSHLEGDDFGPVIAQAQQMAGFPYSEIPHLITVGFGRQTLLGAADTLIDLVSREKLRHIFLVGGCDGARGERNYFTDFATSVPDDCLILTLACGKYRFNKLEFGDIEGLPRLVDAGQCNDAYSAIILAVTLAEKLGCGVNDLPLSLVLSWFEQKAIVILLTLLSLGVKNIVTGPTAPGFFTPDLLAILNEKFGLRSVTTVEEDMKQLLSA

SEQ ID NO: 28252 - protein, 445 aa, Unknown
  Frankia sp. CcI3
MGAPILVDNADLAVKTLGVCRIDSPLLPLLGERPTTQHYIDESDKVLYDDTALMISSRGVALDDLPGFEPAGPRRKIYFDPSKTRVGIVTCGGLCPGLNNVIRGLVLELTSHYRVRRIFGFRNGYQGFIARYGHDVVDLTPESVANIDEDGGTILGSSRGQQDPAEIVDCLSRMNINILFVIGGDGTLRGAGQIAREAETRGEKIAVVGIPKTIDNDIPYIDQSFGFQTAFGKAAESIRVAHAEATSAPGGLGVVRLMGRHSGFIACYATLAKSNADVVLIPELPFKLEGDGGLLNYVRRRVAERGHAVVVVAEGAGQELVVGQPESTDASGNRKLHDIGPELSRRIKEYFDAEGIELNLKYIDPSYVIRSVPANPYDSVYTIRLAHAAVHAAMSGRTEMVVGRWRRRFIHIPIPLAISQRNQVDPAGDLWMSVLEATGQPPRFE

SEQ ID NO: 28253 - protein, 554 aa, Nocardia farcinica
MSAPAAKPAILSVDDDPGVSRAVVRDLRRRYGADYRILRAESGDQALEALREMKLRGQPVAVLIADYRMPGMNGIEFLEHAMDLHPYARRVLLTAYADTDAAIDAINVVDLDHYLLKPWDPPEEKLYPVLDALLEAWRGSEHRPVTETKVVGTRWSPRASQVREFLARNQLPYRWYLADEPEGARLLEAAGAEPERCPVVITSAGQVLLQPTDSVLAEHVGLTVNPAGEFYDLIVVGGGPAGLGAAVYGASEGLRTVLVERTATGGQAGQSSRIENYLGFPDGLSGAQLADRARRQAAKFGAEVVTTREVVGLEVNGSARTVRFADGGRLCGHTVIIATGVDYRRHPAPGVDEFTGRGVYYGSAMTEAAECADREIYIVGGANSAGQAAVFLSRNARTVHLVVRADSLTKSMSHYLIEQIRQIPTIQVHTETEVVGAIGDDHLRQIVLRDNRTGAEEKADTERLFLFIGAAPQTDWLDGVVARDPAGYVLAGPDLLVEGTRPAGWELDRPPHHLETSVPGVFVAGDVHAESAKRVASAVGEGAMAVMFVHRYLA

SEQ ID NO: 28254 - protein, 321 aa, Durio zibethinus
FIILCGATHFINLWTFTMHSKAVAVVMTIAKVSCAIVSCATALMLAHIIPDLMSVKTRELFLRNKAEELDREMGFILTQEETGRHVRMLTHEIRSTLDRHTILRTTLVELGRTLGLEECALWMPSRTGMNLLLSHTLNYQIKVGSTVPINLPIINEVFNSARAVHIPYTCPLASMIRPLVGRYVPPEVVAVRVPLLHLSNFQINDWPDLSAKSYAVMVLILPTDSARKWRDHELELVEVVADQVAVALSHAAILEESMRARNQLVEQNVALDLARREAEKAIHARNDFLAVMNHEMRTPMHAIIALCSLLLETDLTPERIP

SEQ ID NO: 28255 - protein, 253 aa, Oryza sativa
MALAPILSSSSTGRYHAPSLAPPVLMQRALELKFHLYPCNGQGEAVDDKRERELLESLADLYAIIKATEKLERAYVRDLVSAADYEAECLKLISQFNSLSSSLAGVVTIPRFVEAYRLDCPAALNRLVQSGVPATVELRAAASSSAPASSAASAAAIAQCVQSFITAMDAVKLNMLANDQVRPLLHDLSTSMGKLGPVLPPDFEGKVKVSEWLAKLNKMGAGDELTEQQARQLNFDLDSAYSAFMASLPSTGL

SEQ ID NO: 28256 - protein, 556 aa, Vibrio angustum
MTESFAQLFEESLNQVETRPGAIVKGTVVAIENGYVLVDAGLKSESSIPAEEFKNAAGELEIEVGAQVDVALDAIEDGFGETKLSREKAKRHEAWIQLEKAYEDAETVVGIINGKVKGGFTVELNGIRAFLPGSLVDVRPVRDTAHLENKELEFKVIKLDQKRNNVVVSRRAVIESENSVERDELLASLQEGMEVKGIVKNLTDYGAFVDLGGVDGLLHITDMAWKRVKHPSEIVNVGDEINVKVLKFDRERTRVSLGLKQLGEDPWVAIAKRYPESTKLTGRVTNLTDYGCFVEIEEGVEGLVHVSEMDWTNKNIHPSKVVNVGDEVEVMVLDIDEERRRISLGLKQCKANPWQSFAEMQAKGDKVTGKIKSITDFGIFIGLEGGIDGLVHLSDISWNVSGEDAVRDFKKGDEISAVVLAVDAERERISLGVKQIEEDPFNSFVADTKKGALVTGKVTAVDAKGATVELGEGIEGYLRASEASVDRVEDATLVLSVGDSVEAKFTGVDRKNRVINLSVRAKDVAEEQEAMATLNKQDDAAFGNAMADAFKAAKGE

SEQ ID NO: 28257 - protein, 329 aa, Arabidopsis thaliana
MALSMEFGFSIGSCFKAPNPPVLISASPNKINFTLRRRKKRFLLRVSAVSYKEFAESALEETRKRIVLEPSHLQEKYSSMTGLDGKTELQMLAFKSSKIRLLRSMAIENETMQVFDFAGFMEPEYDTPIFCANFFTSTNVNIVVLDLNPLHQLTDQTDYQDKYYNKIMSIYHKYAETFPWGGKLTGESIKFFSPLVMWTRFSSSKEKHKALFSAFLEYYQAWLEMTIQVREEMEPSHVRANCEAQHKYLTWRAQKDPGHGLLKRLVGEAKAKELLRDFLFNGVDELGTKTFIDYFPEYQTEDGTVSDKRSIIGKSYETRPWDLTGQFIG

SEQ ID NO: 28258 - protein, 192 aa, Clostridium difficile
MRIWKVERNTLETQILVELNIDGSGKAEIDTGIGFLDHMLTLMSFHGKFDLKVICKGDTYVDDHHSVEDIGIAIGEAFKNALGDKKGIRRYSNIYIPMDESLSMVAIDISNRPYLVFNAKFDTQMIGSMSTQCFKEFFRAFVNESRVTLHINLLYGENDHHKIESIFKAFARALKEGSEIVSNEIASSKGVL

SEQ ID NO: 28259 - protein, 174 aa, Borrelia turicatae
MSDKISTLFTEEKIKSKIKDLAQKIRNYYEDKNNVVFISLLKGSFIFFADITREIGLNVKIDFLQASSYKNKTLSSLNVLIKKDIDINIQNSYVIIFDDIIDTGLTYKKIVEHLKTKNPKEIKICTLFNKPSRRLIELKIDYSGFEIENDFIVGYGIDFNEQHRTLKNVAKISK

SEQ ID NO: 28260 - protein, 190 aa, Cichorium intybus
  misc_feature (161)..(161): Xaa can be any naturally occurring amino acid
ARGFLKDVKRIVIKVGTAVVTREDGRLALGRLGALCEQIQILNSQGFEVILVSSGAVGAGRQRLRYRKLVHSSFADLQKPQVELDGKACAAVGQNGLMALYDTLFSQLDVTSAQLLVTDNDFRSPEFRKQLTETVDSLLSYKVIPVFNENDAVSTRRAPYXDSSGIFWDNDSLAALLALELKADLLVLLN

SEQ ID NO: 28261 - protein, 392 aa, Arabidopsis thaliana
MEGTLDEENLVFETTKGIKPIKSFDDMGMNDKVLRGVYDYGYKKPSEIQQRALVPILKGRDVIAQAQSGTGKTSMIAISVCQIVNISSRKVQVLVLSPSRELASQTEKTIQAIGAHTNIQAHACIGGKSIGEDIKKLERGVHAVSGTPGRVYDMIKRGSLQTKAVKLLVLDESDEMLSKGLKDQIYDVYRALPHDIQVCLISATLPQEILEMTEKFMTDPVRILVKPDELTLEGIKQYYVDVDKEEWKFDTLCDLYGRLTINQAIIFCNTRQKVDWLTEKMRSSNFIVSSMHGDKRQKERDDIMNQFRSFKSRVLIASDVWARGIDVQTVSHVINYDIPNNPELYIHRIGRAGRFGREGVAINFVKSSDMKDLKDIERHYGTKIREMPADLV

SEQ ID NO: 28262 - protein, 473 aa, Cunninghamella elegans
MNNFIFKRLNVKEFYEAETKKLVENGHEFHLRLERTGYVIHTCNPQAIKEILLKGDKFPKYDYNTSNNEDGSFFHEFVGFENVLMTNGSTWKKHRMIVNPAFKTALPSRLFGDCTRDLFKLWDNEYANEPFDSDIHNITERLTLQIIGKAAFDFDFNAILDEKSIWKQTYDGINKAASDPLFILFPILEEKFLWLFPKRQQSFKLLNEWKKMLLSIIEKKREAIQNNVDHGVEEAEKDLLTLMIESEHRGEGALSNEELLSDLIIFFIAGHDTTAFALSAAIYYLAKHPDIQEKARQEAISVLCPNGEVDEDIFPTTEDTKHFVYINQIMKETLRINGSVLFLLSPRLVTQDVNLSGVFIPKGSQINVNIHEVHHNPNVWHDPETFDPDRWASNGEAEQLAGKGMAWVPFSNGNRQCIGMNFSLLEQRVILGSLLRKYEWTLPEDSIHQDYMVNKFNLIPKPIDLKIRFKRRY

SEQ ID NO: 28263 - protein, 1207 aa, Solanum lycopersicum
MKAHKTVFNQHPLSLNKLFFVLLLIFFLPPASPAASVNGLYKDSQQLLSFKAALPPTPTLLQNWLSSTGPCSFTGVSCKNSRVSSIDLSNTFLSVDFSLVTSYLLPLSNLESLVLKNANLSGSLTSAAKSQCGVTLDSIDLAENTISGPISDISSFGVCSNLKSLNLSKNFLDPPGKEMLKAATFSLQVLDLSYNNISGFNLFPWVSSMGFVELEFFSLKGNKLAGSIPELDFKNLSYLDLSANNFSTVFPSFKDCSNLQHLDLSSNKFYGDIGSSLSSCGKLSFLNLTNNQFVGLVPKLPSESLQYLYLRGNDFQGVYPNQLADLCKTVVELDLSYNNFSGMVPESLGECSSLELVDISYNNFSGKLPVDTLSKLSNIKTMVLSFNKFVGGLPDSFSNLLKLETLDMSSNNLTGVIPSGICKDPMNNLKVLYLQNNLFKGPIPDSLSNCSQLVSLDLSFNYLTGSIPSSLGSLSKLKDLILWLNQLSGEIPQELMYLQALENLILDFNDLTGPIPASLSNCTKLNWISLSNNQLSGEIPASLGRLSNLAILKLGNNSISGNIPAELGNCQSLIWLDLNTNFLNGSIPPPLFKQSGNIAVALLTGKRYVYIKNDGSKECHGAGNLLEFGGIRQEQLDRISTRHPCNFTRVYRGITQPTFNHNGSMIFLDLSYNKLEGSIPKELGAMYYLSILNLGHNDLSGMIPQQLGGLKNVAILDLSYNRFNGTIPNSLTSLTLLGEIDLSNNNLSGMIPESAPFDTFPDYRFANNSLCGYPLPIPCSSGPKSDANQHQKSHRRQASLAGSVAMGLLFSLFCIFGLIIVAIETKKRRRKKEAALEAYMDGHSHSATANSAWKFTSAREALSINLAAFEKPLRKLTFADLLEATNGFHNDSLVGSGGFGDVYKAQLKDGSVVAIKKLIHVSGQGDREFTAEMETIGKIKHRNLVPLLGYCKVGEERLLVYEYMKYGSLEDVLHDRKKIGIKLNWPARRKIAIGAARGLAFLHHNCIPHIIHRDMKSSNVLLDENLEARVSDFGMARLMSAMDTHLSVSTLAGTPGYVPPEYYQSFRCSTKGDVYSYGVVLLELLTGKQPTDSADFGDNNLVGWVKLHAKGKITDVFDRELLKEDASIEIELLQHLKVACACLDDRHWKRPTMIQVMAMFKEIQAGSGMDSTSTIGADDVNFSGVEGGIEMGINGSIKEGNELSKHL

SEQ ID NO: 28264 - protein, 603 aa, Salmonella enterica
MTTNRAFEIRSGYSHTLGANYDGEGVNFAIFSAHAERVELCLYDPSGEHEIARLELPEYTDEIWHGYVTKLQPGALYGYRVYGPYDPENGHRFNPNKLLIDPYARELVGDIQWNDAHFAYQLLHDDKDLTFDDQDSAPFTPKCRVIDPAEANWEDRQRPSIPWSNAIIYETHVKGFTQLNSAIPEPLRGTFEGMGHKASVDYIKSLGITSVELLPVHWFPDDQHLLDKGLKNFWGYNSLGFFAPATRYYGPKGIQGFRDMVRAFHDAGVEVILDVVYNHTAEGNELGPTLSFKGIDNFSYYRTMPDQHRYYINDTGTGNTVNTSHPRVLQMVMDSLRYWAESMHVDGFRFDLGTILGREPEGFDQRGGFFDAVTQDPVLAKLKLIGEPWDIGPGGYQVGGFPPGWGEWNDKYRDTVREYWKGDNVTNDFAARLLGSGDLYDLRGRRSWSSVNFITAHDGFTLNDLVSYNDKHNEANGEDNNDGHNDNRSCNYGAEGPTDDEGINAIRERQKRNFLTTLLFSHGTPMLLAGDEFGRSQMGNNNGYCQDSEISWVHWDNLPETANALREFTRHLIQLRATQPLLRRESWRDGLEIRWFNAGGGAQ

SEQ ID NO: 28265 - protein, 86 aa, Brassica napus
MVSKESCRNEIRAAIRQLSDRCLYSAAKWAGEQLVGIEQDPSNFTPSNTRFQRGSSSIRRRFSTISTPQPSAGFSQPPATPLPQEE

SEQ ID NO: 28266 - protein, 200 aa, Leifsonia xyli
MTNRTASLRRETSESGIELSLDLDGTGASEIHTSVPFYDHLLTAFAKHSLTDLRVRASGDTEIDVHHTVEDVGIVLGQAIRQALGDKAGLSRYGDALVPLDEALVQAVVDLSGRPYLVHAGEPSGFEFHLIGGHFTGSMVRHVFEAISFNAAITTHVTVVGGRDPHHIAEAEFKAFARAFRQAKAYDPLVSGIPSTKGAL

SEQ ID NO: 28267 - protein, 360 aa, Streptomyces avermitilis
MTEAILLVGGRGTRLRPLTVHTPKPMVPAAGVPFLTHQLARARAAGVDHIVLATSYLAEVFEPYFGDGSALGLHLEYVTEEEPLGTGGAIRNVASRLHSGPDEPVLIFNGDILTGLDIRALVHTHETTAADVSLHLTKVTDPRAYGLVPTDETGRVTAFLEKPQTPEEIVTDQINAGAYVFRRSVIDTIPAGRPVSVERETFPGLLSAGAHLQGMVDSTYWLDLGTPAAFVRGSADLVLGRAPSPAVPGRCGDRLVLPTASVASDAKLTGGTVVGEGAFVGEGARIFGSTLLSGAVVEPGAVITDSLLGARSRVGERSILTGAVIGDGAVIGADNELRDGVRVWCDARIPAGAVRFSSDQ

SEQ ID NO: 28268 - protein, 77 aa, Calycanthus floridus
MKEQKLIHEGLITESLPNGMFRVRLDNEDLILGYVSGRIRRSFIRILPGDRVKIEVSSYDSTRGRIIYRLRNKDSND

SEQ ID NO: 28269 - protein, 828 aa, Geobacter metallireducens
MVNLTIDGKQVTVPKDATIYDAAKSAGIRIPILCHDKKLHPFGGCRMCLVEVEQMKGRQIPACTTPVTEGMIVNTMTPEIIQARKLVLELLLLKHPIDCPVCDAAGDCDLQNLTYEYQVNSNRFKDEKFQHQIDYQNPLIERDMNRCVHCGKCARICDEIVSFGAYTFINRGLEAKIGTEFDGPLNCEFCGSCVSVCPVGALVSRPFKFKARWWSLNKVKTVCSYCGTGCQLTLGVKDNKVLTTVYDENQGFHNGQLCTRGRFGYQFVNSDKRLKTPLVKKNGKLEEASWDEALGLVHQRLADAKSVGASSVAGLVTPRLTNEELYLFKQLFNKGIGSDNIDHSAGYAHDALTAGAVESLGYPASPASISDIQTTNLLLVVKTDAYETHPVLGFEINLGVKRKGVNLRIVSDKKGKLSKLPNAITYVHKPASEVLLFNALAKVIVDEGLADSSASSLPGYDDFVKNLGACAPAIVAAQCGMSIEDITTLARDYAKAEKALIMLPIGLAYPGHGKALAQATINLALLTGKIGKEGCGVLIMGEKNNSQGAADLRIHPVAGGRDAMGILDGCASGAIKTLYVVGENPVISYPNRKKVEAALDAVEFLVVQDLFMTETASKADVVLPACSFAEKNGTFTSAGKAVQRVRKAIDTIGMARSDFDIFNSLYSTLGCDSFKGLSEVFAEIASVVPSYSGLTFDGLDENGSVYSVANRLRFVSTVADGQESAAGAMALVTGNALNHCGTLSLHGEGPMYVCPEGYVELNSGDAKKLGVENDQTLTVKSSVGEVKLKAKVSMRMPEGVVFAPYHFSDMSINSITNGAPVTWVTISK

SEQ ID NO: 28270 - protein, 327 aa, Gibberella zeae
MSFNPNNDIPDLSGKVIIVTGASSGLGKESALQLAKHNPATIFVTARTEKRGNAAIKEIQDAVPNFKGQIKFLELDLSSFASIQKGATAFLNQSDRLDILMNNAGLMATPAGLTTDGYEVQFGSNYMGPALFTKLLLPTIVRTAQQQGDARVINLSSELFKQAPKEGVLLSRVKTPLEDISSLARYGQSKLADYYHTRSLSKYYPSVKFVAIHPGVVNTGLFDDLRKRRPWLGGLIGVMGSIFLTDVHAGAKAQLWASTAKSESVRSGGFYNQKLKEYKDAVLDDEKAVEELWDWTEKEFAIIITSIQQKRKVIVEVGYAKLPLQLS

SEQ ID NO: 28271 - protein, 282 aa, Chlamydia trachomatis
MEFSCTLTLKELLESGAHFGHQTSRWNPRMKPFIFEEKNGLYIIDLAKTLAQLKKAVACIQTTIGQEKSILFVGTKKQAKQIIREAAIECGEFFASERWLGGMLTNMATIRNSVKTLNRIELDLEASNSGLTKKELALLAKRHRKLLNNLEGVRHMNSLPGLLIVIDPGYERIAVAEAGKLGIPVMALVDTNCDPTPINHVIPCNDDSMKSIRLIVNVLKDAVIDAKKRLGVEILSPVRPAERPAEEAVEELPLPTGEAQDEASSKEGVLLWADIDNCEALK

SEQ ID NO: 28272 - protein, 478 aa, Medicago truncatula
MGFRNNAIQAGSLDVGGKSKGKMKKDCDEKEIGCCVKFSCFGKCIPSRLKVDSSKSGTTSAHNVENASAYERSKKDRSAPPGSSTTSNAESIPSTPMFSEELKVSSDLRKFTFNELKMATRNFRPESLLGEGGFGCVFKGWIEENGTAPVKPGTGLTVAVKTLNHDGLQGHKEWLAELNILGDIVHPNLVKLIGFCIEDDQRLLVYQFMPRGSLENHLFRKGSLPLPWSIRMKIALGAAKGLNFLHEEAQRPIIYRDFKTSNILLDAEYNAKLSDFGLAKDGPQGENTHISTRVMGTYGYAAPEYVMTGHLTSKSDVYSFGVVLLEMLTGRRAVDKNRPNGEHNLVEWARPVLGERRLLFQIIDPRLEGHFSVKGAQKSAQLAAQCLNRDPKARPMMSEVVQALKPLQNLKDMAIASYHFQVVRVDRTMSMPNSKNGTQTQVASLSKKGQPMRILSSPNGQHGSPYRHYIKSPKPKNG

SEQ ID NO: 28273 - protein, 346 aa, Leuconostoc mesenteroides
MKKLMQGTKKMTKIAVLGGGSWGTALANVAAENNNDVRLWTRTATQADEINSQHTNQKYLPDAKLSSELMATSNMALAVMDAEIVLTVVPTKVVREVARQLADVLNKQDHQVILAHATKGLEQVTYKRVSEMLAEEVPAKYRSTLAMISGPSHAEDVIKHDLTSVSIASENEEAAKLLQQVFANSSFRPYTNHDLLGSELAAALKNIIAIGSGALIGLGYGANAQAALLTRGLSEMRSLGQAMGAQPETFLGLAVIGDLIFTGMSPNSRNYRAGKQLGEGKSLQEIQDDMGMVIEGVSTTKAVYEFSQHHHVEMPITAGIYRILYENEPLRDVISDLMSRPLRSED

SEQ ID NO: 28274 - protein, 178 aa, Unknown
  Sulfitobacter sp. EE-36
MTTRPYVIDEMISAKAIAARIETLCREIQSEFAGTEKLTVVGLLRGSFVFIADLVRELDLPIEVDFLEASSYGDGMESSREVRILKDLRGAIEGRDVLVVEDIVDTGHTLHHVRNLLMSREPARLKTIALLDKPSRREVDMKADWIGFEIPDEFVVGYGIDFAQRDRNQPFIGKVRFT

SEQ ID NO: 28275 - protein, 344 aa, Cryptococcus neoformans
MGKEKVAVVGSGNWGSAISRIAGINTKKHPDVFDDTRVSVWVYEEEFEGKKLTEIINSEHENRKYLPGVKLEDNVVAVPDLKEAVKDATALVFVTPHQFLGKVLDTLEGNVRKDAKAITLIKGVEVQGDDIHIFADVIEQRLGIPCSALSGANIANEVARDTFSETTIGYRNKEDGELWLKLFQTPKFKVQLIDDVAGVSLCGALKNIVAVAAGFIDGLGYGSNSKAAIMRIGLLEMKHFCQEFFVDVKEESFLQESAGVSDVITSCLSGRNYKVAAAFVGANKSFDQLEAEMLNGQKLQGIHTAKDVHNFLSAKNRSRAYPLFDKVYQISWEGVPVEQLTEGL

SEQ ID NO: 28276 - protein, 318 aa, Orobanche ramosa
MATFPVINMEKLNGEERSATMEMIKDACENWGFFELVNHGITAEFMDTVERLTKEHYKKCMEQRFKEMVTSKGLEAIQSEITDLDWESTFFLRHLPVSNISEIPDLEDEYRKVMKEFAGQLEKLAEQLLDLLCENLGLEKGYLKKVFYGTTGPNFGTKVSNYPPCPKPDLIKGLRAHTDAGGIILLFQDDMVSGLQLLKDGEWVDVPPMRHSIVINIGDQIEVITNGKYKSVMHRVIAQTDGTGRMSIASFYNPGNDAVIYPAPALVNKAENNGLYPKFVFEDYMQLYNGVKFQAKKPRFEAFKNMEKITNLGPIATA

SEQ ID NO: 28277 - protein, 414 aa, Oenococcus oeni
MTKNFLDPQLAKAVSGEEERQRHNIELVASENFVSKAVRQAQGSVLTNKYSEGYPGKRYYGGNEYIDIAENLAIERAKELFGVSYANVQPHSGSSANFEAYMAFLHPGDKILGMNLDSGGHLTHGASVSFSGKMYEAQSYKVDSETELLDYDAILKQAKEFKPNLIIAGASAYSRTIDFQAFRDIADEVNAYLMVDIAHIAGLIAAGLHPSPVGLADIITTTTHKTLRGPCGGMILADEKYAKRINSAVFPGSQGGPLDHVVAAKAAAFYEDLQPDFKTYSAQIIKNAKTMADAFSKEPDVRVVSGGTDNHMFTLDLTKTGLNGRQVQDLLDSVSITLNREALPNEKRSPFVTSGVRIGTPAMTTKGLKENEMLQIEHLIMRAIHAHDDKNELTKIKRDVFDLMDKFPFDSNPF

SEQ ID NO: 28278 - protein, 789 aa, Vibrio angustum
MKQVKILAQYYVDLMVKLGIVRFSLLLALALVALAVVVQVSVTLVLHGTVNDIDIVRSVTFGLLITPWAVYFLSVVVDQLEDSRQRLSKLVTKLEEMRSRDMELNKQLQDNIAQLNLEIEEREKAEEAREEAMHDLENEVYQRENAQVAVAEQSALLKSFLDASPDLIYYRNEKNQFSGCNRAMSELVGKTEKELVGLTPWDVYPEEVAKKIIKTDEELFNEDSAMTDEQWLVYPNGKRALFELRKVPFYNRNGRRLGLMGFGRDITERKKYEDALEKASSDKTSFISTISHELRTPLNGIVGLSRMLLDTDLTDEQRGYLRTVHVSAITLGNIFNDIIDLDKSDRRRLELMPKPLDFNEFIDEMGNISQLMAEQKGLRFDLECLTELPKNIEVDSTRLRQVLWNLIGNATKFTKQGGVILSVSSEIHEHDADIIFEVEDSGVGIPKSEIDNIFAMYYQVKQGDDNIHAVGTGIGLAVSRQLVQLMGGDITVHSEVGEGSTFTVKIRVPLVEDVIEEEIVTEVKPELTGLSIFMVEDIELNITVAKSLLESLGHEVTVAMRGDEALAMFKPEDYDLVLLDIQLPDMTGFDIAQKLREKYQDLPALVALTANVISDKSEYLEKGMDEAISKPLSVKAITSVIENLVLSCSYEEDEINDLTDTNSDGTGPSDKMIDKLLDLEMLTSYVDIVGTKPVYASIEMFEKMMPDYIAILDSNMVAKDQDGIKFEAHKIKGAAGSIGLKHIQQVAQKAQSPELPAWWENINDWVDEIKNGYQNDIDVLKTWLKQYEK

SEQ ID NO: 28279 - protein, 359 aa, Nocardia farcinica
MAGQQGTDAVILVGGQGTRLRPLTLSAPKPMLPTAGLPFLTHLLARIAEAGITHVVLGTAFKAEVFEEHFGDGSDLGLEIEYVTESEPLGTGGGIRNVLPKLRHDTVMVFNGDVLGGTDLGAVLDTHHSTGADVTLHLVRVSDPRAFGCVPTDEEGRVTAFLEKTQDPPTDQINAGCYVFRREYIEKIPAGRPVSVEREVFPALLAEGARVQGHVDTSYWRDMGTPEDFVRGSADLVRGIAPSPALPGQRGESLVHPGAGVAPGALLIGGTVVGRGAEIGAGARLDGAVIFDGACVEAGATVERSIIGFGARIGPRALVRDAVIGDGANVGARCELLRGARIWPGVEIPDGGIRFSTDV

SEQ ID NO: 28280 - protein, 429 aa, Phaseolus vulgaris
MAQILAPSTQWQMRFTKSSRHASPITSNTWSSLLMKQNKKTSSAKFRVLAVKSDGSTINRLEGLLNLDITPFTDKIIAEYIWIGGTGIDVRSKSRTISKPVEHPSELPKWNYDGSSTGQAPGEDSEVILYPQAIFKDPFRGGNNILVICDAYTPAGEPIPTNKRHRAAEVFSNPRVIAEVPWFGIEQEYTLLQTNVNWPLGWPVGGYPGPQGPYYCSAGADKSFGRDISDAHYKACLFAGINISGTNGEVMPGQWEYQVGPSVGIEAGDHIWASRYILERITEQAGVVLSLDPKPIEGDWNGAGCHTNYSTKSMREDGGFEVIKKAILNLSLRHKEHISAYGEGNERRLTGKMETASINTFSWGVANRGCSIRVGRDTEKNGKGYLEDRRPASNMDPYVVTSLLAESTLLWEPTLEAEALAAQKLALKV

SEQ ID NO: 28281 - protein, 555 aa, Gloeobacter violaceus
MAKPALLTVDDDPEVLQAVGRDLQSKYGGRFRVLRADSGASALAALKQLQLRNQPVALFLVDQRMPQMSGVEFLEQALPLFPEAKRVLLTAYADTDAAIRAINSVRTDYYLLKPWDPPEERLYPVLDDLLDDWLANHKPPFEGIRVVGNRWSPQSHRVKDFLARQQVPYQWLDLEIQPEAQHLLNAAGDDQAHLPLVVFADGSRLAQPTNAEIAEKLGLRTRAERPFYDLIIVGGGPAGLAAAVYGASEGLSTVMVERQAPGGQAGSSSRIENYLGFPVGLSGADLARRAVAQARRFGVEILSPQEVTGIRIEPPYRVVTLADGSEVSCHALLIATGVSYRKLEVAGAEALTGAGVYYGAAQSEALACSNEAVFIVGGANSAGQAAVYFARYAKQVTMLVRGESLTASMSQYLIEQIAQTENIVVRTRTSVTAVKGESNLEAITVHDDATGETQTLPANSLFILIGAAPNTDWLAGVVERDERGFILAGPDLMRDRRRPRGWTLDRDPFLLETSVPGIFVAGDVRCKSVKRVASGVGEGSIAVQFIHQYLSKVGT

SEQ ID NO: 28282 - protein, 125 aa, Methanosarcina mazei
MKEITAIIRMNRVQKTKDVLLECGFPSFTVRRVMGRGKQKGLCFEFNPPLPEPEKEAETCIHFIPKRMFTIVVDDENVNEVVRKIIEVNQTGHPGDGKIFVSSISEAYRIRTGESGEATVNKEMV

SEQ ID NO: 28283 - protein, 468 aa, Pseudomonas putida
MTDTVEKIQLTRALKSRHIFMLSLGGVIGTGLFMGSGVTINQGGPVGAILAYLVAGLLMYLVMVCLGELSVQMPVSGSFQAHATKFIGPATGFMIGWVYWMSWATTVGLEFTAAGMLMTRWFPDVPIWYWSALFVVVLFGLNALATRAFGEAEYWFSGIKVATILGFIIIGLLVIFGAIPLTSGAPAPMLDNLVGESLFPHGLSAVFAVMMTVVYAFQGCEIMGVAAGETEHPEKSIPRAVRNVVFRVLIFYVLAIAVLSAIVPYEQAGLMESPFVQVFDMVGIPFAADVMNFVILTAILSVGNSGLYASTRILWAMSKSGMAPKSLSPLSKRGVPLRALSITLCFALISLMTSFIAADTLFMVLMAVSGMSGTVTWIVIALAQYRFRKAYLRDGGQLQDLKYRAPLYPLVPLLCITLCSSLFVFLALDETQRPSLYWGFGFIALCYAAYYFVNRRRQGAFEPSVPGV

SEQ ID NO: 28284 - protein, 132 aa, Ostreococcus tauri
MLARTALPTKTTASFNGRVAKQTRTAKRGAKVAARAFDDVNVVMSASNALALYLGRFVFLPYQRAQVERVGMPTQNGQTHFAAGDTRAEEASFITSTNDPAGFNLVDVFAWGSIGHAIGFLALASQSAQQML

SEQ ID NO: 28285 - protein, 379 aa, Marah macrocarpus
MAITCMMATESSPAEEVKREHQVAFGGAGESSVPENFIWPDEFKATADAPELHVPHIDLKKVLSGDEKDVEEATRLVDEACRKHGFFVVVNHGVDKELMNKVHECMNEFFTLPLDVKQKAHRKVGENFGYANSFIGRFSTKLPWKETFSLRYLAHENSSTARDYVSQVLGPEFSHHGEVYQECGKALSDLSLRIVELLGLSLGISRETFRKFYEDNDSIMRMNYYPRCEKPELTLGTGPHCDPTSITILHQDDVSGLQVYVDDQWHSIPPTEDSFVVNVGDTFMSLTNGVYKSCFHRAVVNCKEARKSMAFFLCPAVEKVVRAPEELVEKYPPRKFPDYTWPMLLEMTQKYYRADSNTFNAFTTWIQQQNLDSTASPAV

SEQ ID NO: 28286 - protein, 582 aa, Oryza sativa
MASSAPSAPGLAPVAKPPPPPSKVKVATATVPTNGKIKQGARPMRVSAPPVEPRRRMNPLQRLAAAAIDAVEEGLVAGLLERGHALPRTADPAVQIAGNYAPVGERPPVRGLPVSGRLPACLDGVYVRNGANPLHAPRAGHHLFDGDGMLHAVRLAGGRAESYACRFTETARLRQEREMGRPVFPKAIGELHGHSGVARLLLFGSRALCGVLDASRGIGVANAGLVYHDGRLLAMSEDDLPYHVRVTHDGDLETVGRYDFHGQLDADGTMIAHPKLDPVTGELFALSYNVVSKPYLKYFYFTADGRKSRDVDIPVGAPTMIHDFAVTENYAVVPDQQIVFKLQEMVRGGSPVVYDREKASRFGVLPKRAADASELRWVEVPGCFCFHLWNAWEDDATGEIVVIGSCMTPPDAVFNEPSQSPEEESFRSVLSEIRLDPRTGVSRRRDVLRDAAEQVNLEAGMVNRQLLGRKTRYAYLAIAEPWPRVSGFAKVDLESGTAEKFIYGEGRYGGEPCFVPRAGAAAEDDGHVLCFVHDEERGTSELVVVDAGSEAMEEVAAVKLPGRVPYGLHGTFIGANELQRQA

SEQ ID NO: 28287 - protein, 177 aa, Pisum sativum
ASVFNGKLNILVNNAGTFTPKSILDHTHEDVTTIMSTNFVSGYHLCQLSHPLLKESGYGSIVFISSIAGLKALDISSAYAASKGAMNQFTKNVALEWAKDNIRANVVAPGPVKTLLLENAMKDLAGVDKAVENIVSQSPVGRMGESEDISGLVAFLCLPASSHITGQIIAADGGFTM

SEQ ID NO: 28288 - protein, 174 aa, Geobacillus kaustophilus
MEKATFAGGCFWCMVMPFEELDGIYGIVSGYTGGHVENPTYEQVKTGTTGHYEAVQITFDPDVFPYERLLELYWCQIDPTDDGGQFHDRGPQYRTAIFYHNEKQRQLAEQSKRALEESGRFSKPIVTKILPATTFYPAEEYHQNYHKKNPEHYKQDRAASGRDEFIAKHWGTKR

SEQ ID NO: 28289 - protein, 892 aa, Oryza sativa
MERARRLANRALLRRLLAAATAESPAAPSRGISTLAKGSRPRAPPRPAPHQYTTGRRPVSASALQPSDTFPRRHNSATPAEQAAMASECGFGTVDALIDATVPAAIRAPEMRFSGRFDAGFTESEMIEHMQRLAAMNRAYKSFIGMGYYNTHVPAVILRNLMENPAWYTQYTPYQAEIAQGRLESLLNYQTMVADLTGLPMSNASLLDEATAAAEAMAMCNGILKSKKKTFLIASNCHPQTIDVCQTRAAGFDLNVVVADAKDFDYGSGDVCGVLVQYPGTEGEVLDYAEFVRDAHAHGVKVVMATDLLALTSLRPPGEIGADIAVGSAQRFGVPMGYGGPHAAFLATSQEYKRLMPGRIIGVSVDSSGKPALRMAMQTREQHIRRDKATSNICTAQALLANMAAMYAVYHGPEGLKAIADRVHGLAGTFAQGLKKLGTVTVQELPFFDTVKVKVADANAIAQEACKNEMNLRVVDATTITVAFDETTTLEDVDKLFKVFNGGKPVNFTAESLAPEVSSSIPSSLVRKSPYLTHPIFNMYHTEHELLRYLYKLQSKDLSLCHSMIPLGSCTMKLNATVEMMPVTYPNFANMHPFAPTDQAAGYHEMFDDLGDLLCKITGFDSFSLQPNAGASGEYAGLMVIRAYHRARGDYHRDVCIIPVSAHGTNPASAAMCGMKIVAVGTDSKGNINIEELRKAAEANKDNLAALMVTYPSTHGVYEEGIDEICMIIHENGGQVYMDGANMNAQKHYPVLFRGVNGTVAHEFIIDLRGFKTTAGIEPEDVAKRLMDYGFHAPTMSWPVPGTLMIEPTESESKAELDRFCDALISIREEIAEIESGKADVNNNVLKVKYYYTAICFHILDCRVDNVYGDRNLICTLQQGSQVAEEAAAATA

SEQ ID NO: 28290 - protein, 324 aa, Pseudomonas syringae
MSRIYADNAHSIGNTPLVQINRIAPRGVTILAKIEGRNPGYSVKCRIGANMIWDAEASGRLKPGMTIVEPTSGNTGIGLAFVAAARGYKLMLTMPASMSIERRKVLKALGAELVLTEPAKGMKGAIAKAEELLAGDPETFFMPAQFDNPANPAIHEKTTGPEIWADTDGTIDVLVAGVGTGGTITGISRYIKHTAGKPILSVAVEPDSSPIITQAMAGEEITPAPHKIQGIGAGFIPKNLDLSIVDRVERVTDDESKAMARRLMQEEGILCGISCGAAMAAAVRLAEKPEMQGKTIVVILPDSGERYLSSMLFSDLFTDQELSQ

SEQ ID NO: 28291 - protein, 497 aa, Staphylococcus aureus
MSKVQNESNNVVKRGLKDRHISMIAIGGCIGTGLFVTSGGAIHDAGALGALIGYAIIGIMVFFLMTSLGEMATYLPVSGSFSTYATRFVDPSLGFALGWNYWFNWVVTVAADITIAAQVIQYWTPLQGIPAWAWSALFLVIIFSLNSLSVRVYGESEYWLALIKVVTVIVFIAIGLLTIVGIMGGHVVGFEIFNKGEGPILGGNLGGSLLSILGVFLIAGFSFQGTELIGITAGESENPERAVPKAIKQVFWRILLFYILAIFVIGMLIPYDSSALMGGGNDVATSPFTLVFKNAGFAFAASFMNAVILTSVLSAGNSGMYASTRMLYSMSKDKLAFETFGKTNKNGVPYMSLLVTAIIVVIIFVVQSVTEGAYQYIVAASGLTGFIAWVGIAVSHYRFRRAFDKQNYDKSKLKYTAKWFPFGPIFAAILCIVVIIGQDVDFIKTGDFNFSRFLITYMGIPVFLAFFIYHKLRYKTKKIPLEQVDLRQDVSMDEIKG

SEQ ID NO: 28292 - protein, 455 aa, Ustilago maydis
MSNLPSEPEFEQARNELATTLAPFLEQYPEYNKAFEIVQIPERIIQFRVVWEDDNHVSQVNRGYRVQFNSALGPYKGGLRLHETVNLSVLKFLGFEQIFKNALTGLNIGGGKGGSDFNPKGKSDGEVRRFCKAFATELQRHIGPNTDVPAGDIGFSTREAGFVFGTYKQLRNEWTGVITGKALDWGGSNIRPEATGYGLIYYVEHMINHVEQGTNGFNGKKVVISGSGNVAQYAALKVLELGGTVLSLSDSKGSLIAKDTKGFTAEMISKIAEIKYNRGELESFGTASGALEWHAGARPWKLFSSYDVALPCATQNELNADEAKFSLSAGCRYVAEGSNMGLDQAAIDVYEQSRITDPSKACWYGPGKAANSGGVAVSGLEMAQNSARLTWSPEEVDQKLKDIMKNAYENCFKTGQAFPAKNDKVADKLPSLVGGANIAGFKKVADAMKQHGDWF

SEQ ID NO: 28293 - protein, 1207 aa, Solanum peruvianum
MKAHKTVFNQHPLSLNKLFFVLLLIFFLPPASPAASVNGLYKDSQQLLSFKAALPPTPTLLQNWLSSTDPCSFTGVSCKNSRVSSIDLSNTFLSVDFSLVTSYLLPLSNLESLVLKNANLSGSLTSAAKSQCGVTLDSIDLAENTISGPISDISSFGVCSNLKSLNLSKNFLDPPGKEMLKGATFSLQVLDLSYNNISGFNLFPWVSSMGFVELEFFSIKGNKLAGSIPELDFKNLSYLDLSANNFSTVFPSFKDCSNLQHLDLSSNKFYGDIGSSLSSCGKLSFLNLTNNQFVGLVPKLPSESLQYLYLRGNDFQGVYPNQLADLCKTVVELDLSYNNFSGMVPESLGECSSLELVDISNNNFSGKLPVDTLLKLSNIKTMVLSFNKFVGGLPDSFSNLPKLETLDMSSNNLTGIIPSGICKDPMNNLKVLYLQNNLFKGPIPDSLSNCSQLVSLDLSFNYLTGSIPSSLGSLSKLKDLILWLNQLSGEIPQELMYLQALENLILDFNDLTGPIPASLSNCTKLNWISLSNNQLSGEIPASLGRLSNLAILKLGNNSISGNIPAELGNCQSLIWLDLNTNFLNGSIPPPLFKQSGNIAVALLTGKRYVYIKNDGSKECHGAGNLLEFGGIRQEQLDRISTRHPCNFTRVYRGITQPTFNHNGSMIFLDLSYNKLEGSIPKELGAMYYLSILNLGHNDLSGMIPQQLGGLKNVAILDLSYNRFNGTIPNSLTSLTLLGEIDLSNNNLSGMIPESAPFDTFPDYRFANNSLCGYPLPLPCSSGPKSDANQHQKSHRRQASLAGSVAMGLLFSLFCIFGLIIVAIETKKRRRKKEAALEAYMDGHSHSATANSAWKFTSAREALSINLAAFEKPLRKLTFADLLEATNGFHNDSLVGSGGFGDVYKAQLKDGSVVAIKKLIHVSGQGDREFTAEMETIGKIKHRNLVPLLGYCKVGEERLLVYEYMKYGSLEDVLHDRKKTGIKLNWPARRKIAIGAARGLAFLHHNCIPHIIHRDMKSSNVLLDENLEARVSDFGMARLMSAMDTHLSVSTLAGTPGYVPPEYYQSFRCSTKGDVYSYGVVLLELLTGKQPTDSADFGDNNLVGWVKLHAKGKITDVFDRELLKEDASIEIELLQHLKVACACLDDRHWKRPTMIQVMAMFKEIQAGSGMDSTSTIGADDVNFSGVEGGIEMGINGSIKEGNELSKHL

SEQ ID NO: 28294 - protein, 353 aa, Magnetospirillum magnetotacticum
MEAEMTAKRRVYFNEFNLLMGNTTYLPLVSGLLKAYALTRPALVDSYEFMPFHFHIEAPGPIVDRHQDPFVAAFSLSLWNEQLSLDVARKVKARFPQCVIVMGGAQVPHRPESFFAAHPFLDVAVRGEGEEAFADILERLAEGRRDMDGLPGISWRTPEGEVRIDHSERPFQRDLDAYPSPYLTGLFDDLFVNHPDKNFQAIIETNRGCPFHCTFCYWGKGGLSRKYRYTSLERTFGEIEWMAAHGIRYLFNADSNFGMHRRDIEIAQKIVETKQAKGSPRPSGPATARIRTRRSWKSAACCTSTGWRKASPSATRASPPRCKRTSNATTSNCRWPRGFSAPSTRRACRSIPS

SEQ ID NO: 28295 - protein, 453 aa, Bordetella bronchiseptica
MEKKIVLVKPYSAYERDKTPAENADLTRVEKGSPMGEYLRRFWQPVALSEELGELPTAVRMFGEDLVLFRARNGKPGLLEKHCSHRGTSLEFGICEENGLRCCYHGWLFGVDGQILETPGDPPDSQLRFNVCHGAYPLHEYRGIIFGYFGPPADKPEFPVYDTYDIPGDRLVPYCITYPCNWLQVHENVMDPAHAVFLHTRISFTQFAEAWGELPEMDFVPTPTGMIYVTSRRWEDKVWVRSNDIVLPNLAQVGHIWEDGLTPKEFARVAITRWTTPIDDHTCRIIGWRHMHPDADPRGLADESLCGVETVDFFGQNGERPYADRQRMPGDYDAQISQRPIAVHAMENLTRCDRGVAMLRQLLRRESRKIANGEAPAISPLRANGATPTYAHDTVVSIPPADTDDAACVREIGKAITAIVVKGDHHEQADRPEQVRERIRAYAAEQASTATSE

SEQ ID NO: 28296 - protein, 137 aa, Bacillus halodurans
MAIEVGSKLQGKVTGITKFGAFVELPGGSTGLVHISEVADHYVKDINELLTVGQEVQVKVLNVESDGKIGLSIRKALDQPERPKRPHGGGNRGPRTNRPGPSFEDKMARFLKDSEERLATIKRQTESKRGGRGARRG

SEQ ID NO: 28297 - protein, 488 aa, Methanosarcina barkeri
MCGIAGAAGTPDTNEEVKRMLAALGHRGPDACGTYQAKGLSIGNTLLKITGDMLQPLVGKGALVLNGEIFNFRELAAEQGIKTNSDTEVLFALIETKIKEGETPTNAIFSVLSRVNGDYALAYVLGNKLVLARDPVGVKPLFYSLEKEGKKPKLAFASEKKAFSSQKDQIKSFPPGRVMAFDIRNGRLEEKSLTIDPPQERISEEHEASSRLKAALEKAVEIRLTKTSGIAFSGGIDSTFLAALAKNIDPSISLYAVGLPDSHDLVQAQRAAEVAGMSDSLKTHTLSPEEIEAAIPNVIYSTESTDPMKIAIGLPLYFVAKTAKEDGKRVLLTGQGADELFGGYNRHKALLEHGPKVLDRAIYTDLKNISTINLERDDMVTMANSVELRVPFLDKEVIKTGLAISPELKVLKRDSLYIRKYILRKAADGLLPSELLWKEKKAIQYGTGVQKVLDRLAREAGFSKREGNHIEKYLKKVAENQGFDFIFR

SEQ ID NO: 28298 - protein, 494 aa, Magnetospirillum magnetotacticum
MAESVDILFINPGDRKQIYQDLGDEFCGIEPPVFAGLFATYARQKGASVAIYDTPAMMVPAAEAARVAVEEYAPKLVVVPVYGFQPSASTQNMGSAGKIARLIKEANADIPVLFTGTHPAALPRRTMLEEAVDFVCDLEGPVTIWKTLQAIKAGQDSFANVPSLWWRDSEGRIQAPAEREPLVTDLDGEMPGIAWDLLPMDRYRAHNWHCFTHINERQPYASMHTSLGCPYHCSFCCINAPFGKPSYRLWSPQVVVSEIDFLVERYGVKNIKFVDEMFVLNKRHVAGICDLLATRDYDVNIWAYGRVDTMHDELLDKLKAGGVNWICLGIESASDYVRDGAEKVFTNQDVIDTVRRIQSAGIHIIGNYVFGLPDDTIPRMQQTMDLAQELNCEFANFYSAMAYPGSKLYDMAVEKNLPLPREWHHFSQHGYETLPLANDALSAADILGFRDKAWMDYFTNPKYLDMVRDVFGQEVVDHVGRMTQVPMKRKILGQ

SEQ ID NO: 28299 - protein, 241 aa, Oryza sativa
TRPQEGELKLLGTWASPYVSRVKLALHLKGLSYEYVVEEDHFNNKSELLLSSNPVHKKVPVMIHNGKPICESLIIMEYLDEAFPDTAAPLLPADLHDRAVARFWAAYIDDKLVPSWKQAFSGKTGEEKAEGMRHMLAAVDALEAAMEWSYKGKPFFGGDAVGFLDVALGGLLSWLHGTEELCGAKILDAAKTPLLSAWARRFGEMDAAKVALPDVCKLVEFAKMKRVQLEAAMAATTVSRN

SEQ ID NO: 28300 - protein, 392 aa, Medicago truncatula
MAMLIENEVMCLGKSQRSMDGKEVKGARRVKRQRRDAIVPKIGDDANKMAQKQVGENSTTNTSKRSSRFRGVSRHRWTGRFEAHLWDKLSWNTTQKKKGKQGAYDEEESAARAYDLAALKYWGTSTFTNFPISDYDKEIEIMNTMTKEEYLATLRRKSSGFSRGVSKYRGVARHHHNGRWEARIGRVFGNKYLYLGTYSTQEEAARAYDIAAIEYRGIHAVTNFELSSYIKWLKPETTTEENHESQILQKESRTLAPPNNSTLLQESKLLALQKSFFIPNDLNSTEKQESSFENKNYHFLSNKSTSPTALSLLLRSSLFRELLEKNSNVSEDEVTKEQQQQQITSDDELGGIFYDGIDNISFDFDPNSCNIELQERDLHSISCLYQYLNFGQ

SEQ ID NO: 28301 - protein, 179 aa, Bacillus halodurans
MRDEIQEILITEEEIQAKIVELGKQITEEYEGKFPLVIGVLKGAMPFMGDLTKRIDTHLEMDFMDVSSYGKGTVSSGEVKIIKDLDTSVEGRDVLIVEDIIDSGLTLSYLIELFHYRKAKSVKVVTLLDKPEGRKVDLVPDMAGFTVPDAFVVGYGLDYAERYRNLPFIGILKPEVYES

SEQ ID NO: 28302 - protein, 254 aa, Oceanobacillus iheyensis
MAAISMKQLLEAGVHFGHQTRRWNPKMKKYIFTERNGIYIIDLQKTVKKVDEAYNYVKEIASNGGTILFVGTKKQAQDSVRDEAIRSGMYFVNQRWLGGTLTNFQTIRKRINRLKSIEKMEEDGTFEVLPKKEVVNLLKEKERLVKFLGGIKEMNKLPDALFVIDPRKERIAIAEAHKLNIPIIGIVDTNCDPDEIDYVIPANDDAIRAVKLLTSKMADAILEVKQGEETEVVEEEANEAVAEEEAAEEVSTQE

SEQ ID NO: 28303 - protein, 137 aa, Zea mays
  misc_feature (30)..(30): Xaa can be any naturally occurring amino acid
  misc_feature (73)..(73): Xaa can be any naturally occurring amino acid
  misc_feature (87)..(87): Xaa can be any naturally occurring amino acid
  misc_feature (113)..(113): Xaa can be any naturally occurring amino acid
APALTKVSADDAARKPLPPCCLKCQSACAXNRANCHDTGDAGWFTGTQIAFWYITSKVHDFNNPMRPGEAHSXLKWDKSCFKGNSPXYQEILGFESSTYGNVLVLDGIFQLTXKDDCAYLELGTHLPLCSIPAPNML

SEQ ID NO: 28304 - protein, 449 aa, Exiguobacterium sibiricum
MTTVRFDYSKALQFVGQHEVDYMADTVKTLHGAIHNGTGAGSDFLGWVDLPTNYDKAEFEKIQAAAEKIKSDSDVLLVVGIGGSYLGARAAIEMLGHSFHNLLSKEERKAPQIIYAGHNISSTYLHDLFQVLEGKDVSVNIISKSGTTTEPAISFRLLKTFMEDKYGKAGAKDRIYATTDKARGALKTLADSEGYQTFVIPDDVGGRFSVLTPVGLLPIAAAGISIEELMAGARDAQVQFSNENLAENEAYQYAVVRNALYAKGKTIELLVNYEPALHYVSEWWKQLYGESEGKDFKGIFPAAVDFSTDLHSMGQYVQEGRRDLFETVIKVGQARHALTIEKDAQDLDGLNFLEGKSIQFVNDKAAEGTLLAHTDGQVPNLTVELPEMTPYHLGFLFYFFEKACAMSGYLLGVNPFDQPGVEAYKKNMFALLGKPGFEAEKAELEARLK

SEQ ID NO: 28305 - protein, 123 aa, Solanum lycopersicum
TGRLQVETYACALSSVYTFGPTFRAEQSHTTRHLAEFWMVEPEIAFADIQDDMNCAEAYVKFLCQWLLDHCLDDMEFMTKFVDKDALSRLRMVASSNCHRITYTEAIDILEVAAKVKKKKKAL

SEQ ID NO: 28306 - protein, 311 aa, Corynebacterium glutamicum
MGNVYNNITETIGHTPLVKLNKLTEGLDATVLVKLESFNPANSVKDRIGLAIVEDAEKSGALKPGGTIVEATSGNTGIALAMVGAARGYNVVLTMPETMSNERRVLLRAYGAEIVLTPGAAGMQGAKDKADEIVAERENAVLARQFENEANPRVHRDTTAKEILEDTDGNVDIFVASFGTGGTVTGVGQVLKENNADVQVYTVEPEASPLLTAGKAGPHKIQGIGANFIPEVLDRKVLDDVLTVSNEDAIAFSRKLATEEGILGGISTGANIKAALDLAAKPENAGKTIVTVVTDFGERYVSTVLYEDIRD

SEQ ID NO: 28307 - protein, 422 aa, Geobacter sulfurreducens
MKVVTVGTGMAAAEFVERLRLDGFAGEIVMCGDEEFAPYSPCVIPFYLAGEPLETVYWKGSDFYGRYRVTPRLADPVVEVDAERRLVRTASGRSEQYDRLFYAAGARSWYPRPDWLDTRGVFGFKTLSDMVAIDRYIREHNVGEAVVFGGGFIGVDAALALWHRGLAITLVHRNTRVLSQMTDEEGGQFATAKLVEKTGMDIRLRTTVADIVTTGGELSAVRFSDGTARETKLLIVAIGVSPNSEPLRGDDKGVPSDRQMLAEAGIYAAGDVAVTPHAVTGEAGVYATYPNAMRQARTAARHLLNGDGSYAGSVNTNVLKKHIDFPIVSAGSFTGEPVTWQRGDVWRRVYLKDGMINGYIIIGDTKMSGYVYQLYVSRQRVDGTIRTILSSPRHDAYYRQVTGCGAGRASGRGYGMQGVMAG

SEQ ID NO: 28308 - protein, 180 aa, Brassica napus
  misc_feature (149)..(149): Xaa can be any naturally occurring amino acid
  misc_feature (154)..(154): Xaa can be any naturally occurring amino acid
MGKSGKKPRESHRQGRGRRASHFCDEDGYDLPSSAYDATPRQNEESSEDNDDTSDATAEDEPERDTEAGEQDQWQGSMPSKFHLYQLSVQSPKGDISYLQKFFLMYVGGRAPLHLQEDFCGTALLSTEWIRTDARRTAIGLDLDLESLXEWCLXETTLSKIGADGYSRMLLFHGNVLQPM

SEQ ID NO: 28309 - protein, 115 aa, Cryptomeria japonica
  misc_feature (26)..(26): Xaa can be any naturally occurring amino acid
AGPAQGWSTLSQSKPIGSLPLMNTGXLMKQWKMGLKAKRSVKAAYKVKLVTPDGETEIECPDDQYILDAAEDAGIDLPYSCRSGSCSSCAAKVIEGEIEMEDQSFLDDDQIGSGF

SEQ ID NO: 28310 - protein, 374 aa, Methylococcus capsulatus
MQSRNELPGSRRVIVKIGSALLTAGGKGLDQPAIGQWVQQIAELRQQGIQVVLVSSGSVAEGMSRLGWKTRPHRLNELQAAASVGQMGLVQTYESLFKRHGLQTAQILLTHDDLSNRERYLNSRSTILTLLELGVIPVINENDTVTTEEIRFGDNDTLGALVANAVEADLLIILTDQAGLFERNPSLDPSAPLVPQAGINDPRLNDMVGDSLSGLGRGGMITKLRAARLAARSGTATVIASGRESGVLPRILDGEELGTLLIPDVSPLIARKRWMAGQLKLKGCFVVDEGAARVLRDAGKSLLPIGVIAVEGEFRRGDLVACTDSAGQEIARGLTNYSAEEARLIMRQPSTRIEEILGYVDEPELIHRDNLVLS

SEQ ID NO: 28311 - protein, 605 aa, Lycoris aurea
METSIGSVDAAKPAPNGMVGSPPSATAHPITPCLPAAAIPSECTLGGHVARRLVQVGVRDFFGVPGDFNLTLLDHLIAEPGLNYVGCCNELNAGYAADGYARAHGVGACVVTFTVGGLSVLNAIAGAYSENLPLICIAGGPNSNDFGTSRILHHTIGLPDFSQELRCFQTITCFQAVVNNLEDAHELVDTAISTALKESKPVYISISCNLPGIPHPTFTPEPVPFSLSPRVSNKMGLEAAVEATVAFLNKAVKPVMVGGPKIRVAKAGDAFVELANASGYAVAVMPSAKGLVPETHPRFIGTYWGAVSTAFCSEIVESSDAYIFAGPIFNDYSSVGYSLLLKKEKAIIVEPDRVVVANGPAFGCVLMKDFLRELAKRLKKNTTAYENYQRIFVPEGQPLEAAPKEPIRVNILFKHIQKMLSGDTAVIAETGDSWFNCQKLKLPDGCGYEFQMQYGSIGWSVGATLGYAQAAKDKRVIACIGDGSFQVTAQDVSTMIRFGQNPIIFLINNGGYTIEVEIHDGPYNVIKNWNYTAFVEALHNGEGKCWTAKVFCEEDLKEAIETATGPKKGCLCFIEVIAHKDDTSKELLEWGSRVAAANSRPPNPQ

SEQ ID NO: 28312 - protein, 563 aa, Saccharomyces cerevisiae
MSEITLGKYLFERLSQVNCNTVFGLPGDFNLSLLDKLYEVKGMRWAGNANELNAAYAADGYARIKGMSCIITTFGVGELSALNGIAGSYAEHVGVLHVVGVPSISSQAKQLLLHHTLGNGDFTVFHRMSANISETTAMITDIANAPAEIDRCIRTTYTTQRPVYLGLPANLVDLNVPAKLLETPIDLSLKPNDAEAEAEVVRTVVELIKDAKNPVILADACASRHDVKAETKKLMDLTQFPVYVTPMGKGAIDEQHPRYGGVYVGTLSRPEVKKAVESADLILSIGALLSDFNTGSFSYSYKTKNIVEFHSDHIKIRNATFPGVQMKFALQKLLDAIPEVVKDYKPVAVPARVPITKSTPANTPMKQEWMWNHLGNFLREGDIVIAETGTSAFGINQTTFPTDVYAIVQVLWGSIGFTVGALLGATMAAEELDPKKRVILFIGDGSLQLTVQEISTMIRWGLKPYIFVLNNNGYTIEKLIHGPHAEYNEIQGWDHLALLPTFGARNYETHRVATTGEWEKLTQDKDFQDNSKIRMIEVMLPVFDAPQNLVKQAQLTAATNAKQ

SEQ ID NO: 28313 - protein, 408 aa, Lactococcus lactis
MNEFETLLNSVEDVKVRDVVKGEILSVENGQATVAIVGTGVEGVLTLREITNDKDADINTFVKPGDVLDLLVIKQIVGKEAEGANVYLLSLKRLEARKAWTQLEGKEGEIVTVKVTKDVKGGLSVDYNGVRGFIPASMIDTYFVKDTKKFVGEEIEAKIIEVNASENRFILSRRAVVEAEAIEMRKEAFAQLQEGDIVEGTVSRVTNFGAFVDLGGIDGLVHVSELSHSRIKRPSDAVKPGDVVNVKILKLDPEAGRLSLSLKATQPGPWEQVEEKAPVGSTVEGTVKRLTDFGAFVELYPGVEGLVHVSQISWERVENPKDVLKVGQVVNVKVLDVKPAEERISLSIKALEEAPARPARNNDNDGEKRDRKPRAPRKAAKPSYDLPETQEGFSLADFLGEDFDINDL

SEQ ID NO: 28314 - protein, 307 aa, Bacillus halodurans
MRVANSITDLIGQTPLVKLNRLVSDKHADVYLKLEFFNPGSSVKDRIALAMIEAAEKSGALKPDDTIVEPTSGNTGIGLAMVAAAKGYKTKLVMPETMSLERRNLLRAYGAELVLTPGPEGMGGAIRKATELAQENGYFMPQQFENEANPEIHRETTGRELLEQVDGQLDGFVSGIGTGGTITGAGGLLKENFPNLHIAAVEPADSPVLSGGNPGPHKIQGIGAGFVPKILDTDIYDEVIKVSTEQAFEYARRAAKEEGILGGISSGAAIYAALQVAEKLGPGKKVVAVIPSNGERYLSTPLYQFED

SEQ ID NO: 28315 - protein, 785 aa, Ipomoea batatas
MELLHSPSISQYSPKLHSRSSNIRKTGLSFGFPHNYFAEFEKKARPSALAVNAAIDGGGESDTAVVVEKPLPYGLLRRFEVLSGHPAPFGATARDGGINFAVFSSNATSAALCLISLADLPEKKVTEQIPLDPSINKTGDVWHVFLQGDFDNMLYGYSFDGKFAPEEGHYFDSARILLDPYAKAIVSRAEFGALGPEKDCWPPMACMLPTADKFDWEGDLPLKFPQRDLVIYEMHVRGFTNHESSGTEFPGTYRGVVEKLDHLKVLGVNCIELMPCHEFNELEYYSYNPVLGDYKVNFWGYSTVNFFSPMGRYSSAGMHKSGLGAIDEFKYLVREAHRRGIEVIMDVVFNHTAEGNENGPMFSFRGVDNSVFYMLAPKGEFYNYSGCGNTFNCNHPVARQFILEFLRYWVIEMHVDGFRFDLASILTRVAGDMLTTGAPLSSPPLIDMISSDPILSGVKELIAEAWDCGGLYQVGAFPHWGIWSEWNGKYRDIVRQFIKGTDGFSGAFAECLCGSPNLYQEGGRKPWNSINFVCAHDGFTLADLVTYNDKHNMANGEDNKDGENHNNSWNCGQEGGFASISVKKLRKRQMRNFFLCLMVSQGVPMIYMGDEYGHTKGGNNNTYCHDNYINYFRWDKKDESSTDFFRFCCHVTKFRHEAESLGLDDFPTAERLQWHGHTPGMPDWSESSRFVAFTLVDKVKGEIYIAFNASHLPVTVTLPERGGYRWEPLVDTGKQTPFDFLGDDVPEKKTALKQYAHFLDANMYPMLSYSSIILLLCPDEMIENS

SEQ ID NO: 28316 - protein, 588 aa, Brassica napus
MSLPETKSQTLLDAWDFQGRPADRSKTGGWASAAMILCIEAVERLTTLGIGVNLVTYLTGTMHLGNATAANTVTNFLGTSFMLCLLGGFIAHTFLGRYLTIAIFAAIQATGVSILTLSTIIPGFQPPRCPTTSSHCVQPSGIQLTVLYLALYLTALGTGGVKASVSGFGSDQFDETEPKEQSQMTYFFNRFFFCINVGSLLAVTVLVYMQDDVGRKWGYGLCALAIVLSLSIFLAGTNRYRFKKLIGSPMTQVAAVIVAAWWNRRLELPSDPSFLYDLDDVIAAEGSMKSKQKLPHTNQFRSLDKAAIKDQEMAMTQNVYNKWTLSTVTDIEEVKQIVRMLPIWATCILFWTVHAQLTTLSVAQSETMDRHIGSFEIPPAAMAVFYIGGLLLTTAVYDRLAIPLCKKLFNYPHGLRPLQRIGLGLLLAAMGMAVAALVEIKRLRTAHAHGPTVKTLPLGFSLLIPQYLIVGIGEALIYTGQLDFFLRECPKGMKTMSTGLLLSTLALGFFFSSVLVTIVEKVTDKAHPWIADDLNKGRLYNFYWLVAVIVALNFLVFLVFSKWYVYKEKRLADLGIELEDEPDIPMGH

SEQ ID NO: 28317 - protein, 455 aa, Unknown
  Marinobacter sp. ELB17
GIINGKVKGGFTVDLAGIRAFLPGSLVDVRPVRDTAHLENKELEFKVIKLDQKRNNVVVSRRAVLEAENSAEREALLETLTEGLTIKGIVKNLTDYGAFVDLGGVDGLLHITDMAWKRIKHPSEIVNVGDEINVKVLKFDRERNRVSLGLKQLGEDPWVEIKARYPEGSKVTARVTNLTDYGCFAELEEGVEGLVHVSEMDWTNKNIHPSKVVQVGDEVGVMILDIDEERRRISLGIKQCVSNPWEDFSGNFNKGDRISGKIKSITDFGIFIGLDGGIDGLVHLSDISWNETGEEAVREYKKGDEVDTVILSVDPERERISLGIKQLESDPFAEFVQLNDKGSIVKGVVSAVDAKAATITLSDEVEAILKASEISRDRVEDARNALKEGEEVEAKIISIDRKNRIINLSVKSKDVEDDKQALDTVRTKTVESSSGATTIGDLIKEQMQQQNANKD

SEQ ID NO: 28318 - protein, 204 aa, Orobanche caryophyllacea
  misc_feature (33)..(33): Xaa can be any naturally occurring amino acid
GVHFGHGIKKWNPKMAPYIYISAKHKDIHIINXIKTARFLSEACNLVFDAASRGKQFLIVGTKKQTANSVACAAIKARCHCVNKKWLGGTLTNWSTTESRLNQFRDLRIEQKMGRFKRLPKRDAAVCKRQLSRLQTYMGGIKYMTGLPDIVIIVDQHEEYTALRECITLGIPTICLIDTNCDPDLABFSIPANDDSIFSIRLIL

SEQ ID NO: 28319 - protein, 417 aa, Halobacterium salinarum
MPEANPFESLQEQLDDAGEFLDVNADVLERLKHPERVLETTLSVEMDDGTIETFKAFRSQFNGDRGPYKGGIRYHPGVTRDEVKALSGWMVYKTAVADIPYGGGKGGIILDPEEYSDSELERITRAFATELRPFIGEDKDVPAPDVNTGQREMNWIKDTYETLEDTTAPGVITGKALENGGSEGRVNATGRSTMFAAREVFDYLDRDLSDATVAVQGYGNAGSVAAKLIADQGADVVAVSDSSGAVHNPDGLDTRAVKAFKTETGSVSGYEGATEELSNEALLTMDVDLLVPAALENAIDEDLAHDVDADVVVEAANGPLTPDADDVLTERGVTVVPDILANAGGVTVSYFEWVQNRQRFQWTEDRVNEELEAIITDAFDAMTDAHEDAGTPNLRTAAYVVAVQRVVDAYEGSGSWP

SEQ ID NO: 28320 - protein, 320 aa, Coprinopsis cinerea
MGFTTLVTCDVYLGMFGWWAEVSQYRFIKPPSLLFTSYAYLTPRLMANWARFFSSFRNVIAFFKEAWFLGRPAWTVKDIPDLSGKVYIVTGGNSGLGADTVRALLKHRARVYIAARNEEKSLAFIEELFDETGHKAHFLKVDLADLGSVEAAASEFNRKEARLDVLFNNAGTLNLSIEAVTNGYDMAFHTNVLGPFYFTKLLLPHLLQTARLSDTKDHVRIVNLTSSAHHFAGSPPIDFSSLKDGPGRRKYTDLDHFYAQSKAAMVLFSNELARRYAEKGVISLAVNPGNFATSLTRGIQDYWRNTFSANPEILAVYLSP

SEQ ID NO: 28321 - protein, 463 aa, Bacillus cereus
MQHTNKSGTLNRGLKERHITLMSLGSAIGVGLFLGSASAIKLAGPSILLGYMIAGLVIFFIMRALGEMAIEQPVAGSFSKYAYDYIGPLAGYITGWNYWFLWVVTCMAEITAAGIYMQYWFPDIPRWTWALLALLLMSAFNFLSVKVFGELEFWFALIKIVTIICMIVVGAGIILFGFGNGGIATGISNLWSHGGWFPNGFSGLLLSMQMVLFAYLGVELIGVTAGEAQNPKKTLAKAIDNVFWRILLFYVGALFVMMAIYPWNELGEKGSPFVLTFQQIGIAKAAGIINFVVLTAALSSCNGGLFSTGRMLYTLAQQKKAPERFGRLNKNGIPSQGIVATAIVLLIGVILNYLVPAKVFTWLTSISTFGAIWTWGIILVAQIKFRKSLPTQNKQKLSYKMPLYPLSSYFSLVFLVLVLGIMAYSEDTRIALIVGPIWLIGLAIVYYMKGFHKIDETPNSKIS

SEQ ID NO: 28322 - protein, 510 aa, Streptococcus pyogenes
MALSPDIKEQLAQYLTLLEADLVLQVSLGDNEQSQKVKDFVEEIAAMSERISIENITLDRQPSFKVAKKGHDSGVVFAGLPLGHELTSFILALLQVSGRAPKVDQDVIDRIKAIDRPLHFETYVSLTCHNCPDVVQALNIMSVLNDKISHTMVEGGMFQDEVKAKGIMSVPTVFLDGEEFTSGRATIEQLLEQVAGPLSEEAFADKGLYDVLVIGGGPAGNSAAIYAARKGLKTGLLAETFGGQVMETVGIENMISTLYTEGPKLMAEVEAHTKSYDVDIIKAQLATSIEKKENIEVTLANGAVLQAKTAILALGAKWRNINVPGEDEFRNKGVTYCPHCDGPLFEGKDVAVIGGGNSGLEAALDLAGLAKHVYVLEFLPELKADKVLQDRAAKTNNLTIIKNVATKDIVGEDHVTGLSYTERDSGEDKHLDLEGVFVQIGLVPNTAWLKDSGVNLTDRGEIIVDKHGSTNIPGIFAAGDCTDSAYKQIIISMGSGATAAIGAFDYLIRQ

SEQ ID NO: 28323 - protein, 79 aa, Solanum lycopersicum
QETIAAYGEGNERRLTGRHETADINTFKWGVANRGASIRVGRDTEKEGKGYFEDRRPASNMDPYVVTSMIAETTILWNP

SEQ ID NO: 28324 - protein, 639 aa, Oryza sativa
MTNSNNGNGGTNAAASGWLGFSLSPHMASSTMDEHHHVHHHQQQQQQQQQQQHHQQQQHGLFFPSVTTAAAAAAYGLAGDVVAATNGYYSQLASMPLKSDGSLCIMEALRRTDQDHHGPKLEDFLGAAQPAMALSLDNTSSFYYGGGGAAAAGHGQHGYLQACDLYGGPAAPSLVTAADEEAAAAAAAMASWVAARGAATAYATGAADANAAENVLPSATAAQHLHHPLALSMSSGSLSSCITAGEYGMAAVAAADGGRKRGGAGGGGQKQPVHHRKSIDTFGQRTSQYRGVTRHRWTGRYEAHLWDNSCKKEGQTRKGRQGGYDMEEKAARAYDLAALKYWGPSTHINFPLEDYQEELEEMKNMTRQEYVAHLRRKSSGFSRGASMYRGVTRHHQHGRWQARIGRVSGNKDLYLGTFSTQEEAAEAYDVAAIKFRGLNAVTNFDITRYDVDKIMASNTLLPADLARRNAATTTSKDDHSAAGAGAIVSVHSAADIAVADTLWKATTAPRQQQQHHDDVVLSGADQAAFSVLHDLVAVDAAAAHQQQQQQQHMSMSAASSLVTSLSNSREGSPDRGGGLSMLFAKPSPAVAASAQQQASTKLMAAPLPLGSWVSSPPASARPPAVSIAHMPLFAAWTDA

SEQ ID NO: 28325 - protein, 500 aa, Nostoc punctiforme
MLKKLFSFSDRYRILHQTWFAFFLTFVCWFNFAPFATTIGKELHLAPEQIKTLGICNLALTIPARLIIGMLLDRFGPRITYSILLMFAVVPCLATALAQDFNQLVISRLLMGIVGSGFVVGIRMVAEWFQPKEMGIAQGIYGGWGNFGAFGAEFALPILAISTSFFSGGASNWRLAIALVGIITAIYGVIYYNTVQDTPRGKVYKKPKKNGSLEVTSIKSFWAMMISNFGLIFALGLLAWRLEQKKIHFLTLSQMYLTWLVLAGLFAYQSYKAWQVNRELLTGKKTYPVSERFQFGQVALLEFTYITNFGSELAAVSMLPAFFEKTFGLEHVVAGMIAATYPFLNLVSRPSGGLISDKFGSRKWTMTIISVGIGVSYLMAHFINSNWPIPVAIAVTMFAAYFAQAGCGATYSIVPMIKKEATGQIAGNVGAYGNFGGVVYLTIFSLTDAPTLFSTMGIAALICAFMCAFFLKEPKGSFAPAYEGEASETATKSSVFLTEE

SEQ ID NO: 28326 - protein, 705 aa, Oceanobacillus iheyensis
MAEEKQLFSTEISGKKFTVEVGELAKQANGACMIHYGDTSVLSVATASSEPKDLPFFPLTVNYEERLYAVGKIPGGFIKREGRPSEKAILSSRLIDRPIRPLFPDGFRNEVQVISTVMSVDQDCPSEIAAMIGSSIALSVSDIPFEQPIAGVNVGRVDGEFIINPTIEQEAKSDIELTVAGTKDAINMVEAGANEVPEDIMLEAIMFGHEEIKRLVAFQEELVKACGQDKFDVVLAESEEELVENVHSEAKDKIVNAIQVQEKHARDEAIKQAKNEIVAHYEEQEVEEDVIKQVKSILDSMVKEEVRRLITKEKIRPDGRKVDEIRPLSSRIHVLPRTHGSGLFTRGQTQALSVCTLGALGDVQILDGLDLEESKRFMHHYNFPQYSVGETGPIRGPGRREIGHGALGERALEKVIPDDKEFPYTIRLVSEVLESNGSTSQASICASTLAMMDAGVPIKAPVAGIAMGLVKSGDDYTILTDIQGMEDALGDMDFKVAGTANGVTALQMDIKIDGLSRDILEEALSQAKKGRMQILDSMLATIKEPKEELSEFAPKILTMAIEPDKIRDVIGPSGKQINQIIDETGVKIDIEQDGSIFISSTDNEMNKKAKQIIEDLVREVEVGQIYLGKVKRIEKFGAFVELFKGKDGLVHISELAEERTNKVEDVVSIDDQIMVKVKEIDRQGRVNLSRKAVIQDEKKAKEQAK

SEQ ID NO: 28327 - protein, 108 aa, Ipomoea nil
VYPYKIIIKTCGTTKLLLSIPPILELADGLSLKVKSVKYTRGSFNFPEVQPYPHRNFSEEVAILDGYFGKLGTGSKAYVMSDAGKQQQWHVYSASAESAENTFPIYTL

SEQ ID NO: 28328 - protein, 760 aa, Nostoc punctiforme
MSEFTKTLCPYCGVGCGLEVSPPAQLGKATNRDGQGNPTWRVRGDKAHPSSQGMVCVKGATIAESLDKNRLHYPMVRDSLDQEFRRVSWDEAFNLITQRIQTVRFTQGPEALCMYGSGQFQTEDYYIAQKLMKGCLGTNNFDANSRLCMSSAVAGYIQSFGSDGPPCCYEDLELTDCAFLIGTNTAECHPIVFNRLEKYHKKNRKVKMIVVDPRRTPTAEAADLHLAIRPGTDIDLLNGIAHLLMRWNYIDTMFMDDCTSNFPAYAEVIRHYSPEVVARQCGISIEDLETAARYWGESRRVLSLWSMGVNQSSEGTAKVRTIINLHLMTGQIGKPGAGPFSLTGQPNAMGGREAGGLAHLLPGYRVVKNPQHRAEVEEFWGLKPGQISPNPGLTAWDMITGLESDAVGLLWIAATNPAVSMPDLERTKKALLRSPFTIYQDAYYPTETSAYAHVLLPAAQWGEKTGVMTNSERVVTLCQAFRQPPREAKADWEIFAEVGRRLGFEKEFAFANSAEVYAEFVQLTQNRPCDMTGISHEQLTQGPTQWPYPAKKVESVFIDTETGLLSFQPEEETFSDKEAEKKRKYHTLRMGKRLYTDLRFHTPDGRAQFGAYYSKGLAEPPDPDYPFVLTNGRLYGHWHTQTRTGRIEKICKMHPEPFIEIHPRDAAKLGILDNQCVQVRSRRGKAQFPAKVTKAIAPGTVFVPMHWGSLWADNAEANALTHPESCPDSLQPELKACAVQLIPISVEVAVKDYQFQSSQC

SEQ ID NO: 28329 - protein, 66 aa, Arabidopsis thaliana
  misc_feature (14)..(14): Xaa can be any naturally occurring amino acid
  misc_feature (32)..(32): Xaa can be any naturally occurring amino acid
  misc_feature (41)..(41): Xaa can be any naturally occurring amino acid
  misc_feature (47)..(48): Xaa can be any naturally occurring amino acid
  misc_feature (51)..(51): Xaa can be any naturally occurring amino acid
  misc_feature (54)..(54): Xaa can be any naturally occurring amino acid
  misc_feature (56)..(60): Xaa can be any naturally occurring amino acid
MASFTASASTVSAXRPALLLKPTVAISAPVLXLPPMGKKKXGARCSXXTKXGNXIXXXXXESVNKQ

SEQ ID NO: 28330 - protein, 388 aa, Oryza sativa
  misc_feature (371)..(371): Xaa can be any naturally occurring amino acid
MEGGGAKDGSAAAAQTRGSGDDGSHKPLPPCCLKAKAAAAESEAKCHATVVSGWFTEPRSHSGKTSKVQYFNNPMWPGEAHSLKVENILYQGKSPYQEILVFESSTYGNVLVLDGIVQLTEKDECAYQEMVTHLPLCSIPSPKSVLVVGGGDGGVLREIARHASVENIDICEIDQLVIDVCKDFFPQLSVGFKDPRVQLHVGDAVDFLRNAPEGKYDAIIVDSSDPIGPAQELVEKPFFQTIARALKPGGVLCNQAESMWLHTHLIQDMLSICRETFKGAVHYAWTSVPTYPSGVIGFLLCAKEGPAVNFLSPVNPIEKLEGAMEAGREIRFYNSEVHRAAFVLPTFVRRELESHNTCAEKDKSETKPVAXKPKKMKIMPNSAIPTAS

SEQ ID NO: 28331 - protein, 339 aa, Arabidopsis thaliana
MGEAVEVMFGNGFPEIHKATSPTQTLHSNQQDCHWYEETIDDDLKWSFALNSVLHQGTSEYQNIALLDTKRFGKVLVIDGKMQSAERDEFIYHECLIHPALLFHPNPKTVFIMGGGEGSAAREILKHTTIEKVVMCDIDQEVVDFCRRFLTVNSDAFCNKKLELVIKDAKAELEKREEKFDIIVGDLADPVEGGPCYQLYTKSFYQNILKPKLSPNGIFVTQAGPAGIFTHKEVFTSIYNTMKQVFKYVKAYTAHVPSFADTWGWVMASDHEFDVEVDEMDRRIEERVNGELMYLNAPSFVSAATLNKTISLALEKETEVYSEENARFIHGHGVAYRHI

SEQ ID NO: 28332 - protein, 322 aa, Staphylococcus aureus
MKKIAVLTSGGDSPGMNAAVRAVVRTAIYNEIEVYGVYHGYQGLLNDDIHKLELGSVGDTIQRGGTFLYSARCPEFKEQEVRKVAIENLRKRGIEGLVVIGGDGSYRGAQRISEECKEIQTIGIPGTIDNDINGTDFTIGFDTALNTIIGLVDKIRDTASSHARTFIIEAMGRDCGDLALWAGLSVGAETIVVPEVKTDIKEIADKIEQGIKRGKKHSIVLVAEGCMTAQDCQKELSQFINVDNRVSVLGHVQRGGSPTGADRVLASRLGGYAVDLLMQGETAKGVGIKNNKIVATSFDEIFDGKDHKFDYSLYELANKLSI

SEQ ID NO: 28333 - protein, 208 aa, Oryza sativa
  misc_feature (121)..(121): Xaa can be any naturally occurring amino acid
VKSSTPTTSSFDSELQKGGNRLDSSDHRGNFSSTTDRSDTGTDVNIRDKEAFEMPVQYPVVCFSSSNLHLERSNEGQNDASGTPPVYHFPFYYPGMMDHGMTHPPVQNFQGNINNAQVHTXMPEETCSRSERRAAALAKFRLKRKERCFDKKVRYVNRKKLAETRPRVRGQFVRQANYTDITSTGDDISEDEDDDPSSREVEMVSSPE

SEQ ID NO: 28334 - protein, 417 aa, Oryza sativa
MSSGGGRPPAAQHIVRSVRQRFVPLPPPLARAPFAAAPGDYHRFAAASRGGEIEEGIVIRRTPLKRKTPCGESEAAESSERMMTSPGFTEGVGSPLMTPVSGKTSRTTKSMAKFNKAGPQTPISNAGSPGNPSTPASSRYDNSLGLLTRKFINLLKQTQDGILDLNDAAKILDVRKRRIYDITNVLEGTGLIEKKLKNRIRWRGSDDSGTNLDSDISCLKTEVENLYIQEQALDRSISEIREKMEELTEDESNHRWLFVTEDDIKGLPCFQNEALIAIKGPRGTTVEVPDPDEAGDYLQRRYRILLRSTMGPIDIYLVSQYKKMEELGETATPPRHASVVEPPSIATEAGHSSKQTMPLNVQQDIQETPELNASRAFGRMKKITPSDVDTDADYWLLTDDDISITHMWTTACILDEI

SEQ ID NO: 28335 - protein, 605 aa, Lycoris aurea
METSIGSVDAAKPAPNGMVGSPPSSTAHPITPCLPAAAIPSECTLGGHVARRLVQVGVRDFFGVPGDFNLTLLDHLIAEPGLNYVGCCNELNAGYAADGYARAHGVGACVVTFTVGGLSVLNAIAGAYSENLPLICIAGGPNSSDFGTSRILHHTIGLPDFSQELRCFQTVTCIQAVVNNLEDAHELVDTAISTALKESKPVYISISCNLPGIPHPTFTPEPVPFSLSPRVSNKMGLEAAVEATVAFLNKAVKPVMVGGPKIRVAKAGDAFVELANASGYAVAVMPSAKGLVPETHPRFIGTYWGAVSTAFCSEIVESSDAYIFAGPIFNDYSSVGYSLLLKKEKAIIVEPDRVVVANGPAFGCVLMKDFLRELAKRLKKNTTAYENYQRIFVPDGQPLEAAPKEPIRVNILFKHIQKMLSGDTAVIAETGDSWFNCQKLKLPDGCGYEFQMQYGSIGWSVGATLGYAQAAKDKRVIACIGDGSFQVTAQDVSTMIRFGQNPIIFPINNGGYTIEVEIHDGPYNVIKNWNYTAFVEALHNGEGKCWTAKVFCEEDLKEAIETATGPKKGCLCFIEVIAHKDDTSKELLEWGSRVAAANSRPPNPQ

SEQ ID NO: 28336 - protein, 733 aa, Rhodopseudomonas palustris
MTDTNETLELPPETKPAEPAAKPQAAPGYNVFNDTKAVREGLPYPLGSCWDGHGTNFALFSANATKVEVCLFDGDTERRIELPEYTDEVFHGYIPDIGPGTFYGYRVYGPYEPENGHRFNPNKLLLDPYARAHAGLLTWDPAVFGYVMESGDDTTFDERDSARFVPKCVVVDPDFDWKGEPGRKFVPWDQAIIYETHVKGFTKLHPDVPEHLRGTYAGFGTKPVVDYISSLGVTAVELLPIHTFVNDSYLLDKNLVNYWGYNTIGFFAPDPRYAADVPNSLREFKEMVARLHDVGLAVILDVVYNHTAEGNELGPTLSFKGIDNASYYRLLPEQKRYYINDTGTGNTVNLTHPRVIQMVNDSLRYWAGEMHIDGFRFDLGTILAREHYGFDEQSGFLKSVMQDPLLSSVKLIAEPWDCGPGGYQVGGFPPGWAEWNDKFRDTARDYWRGEAPAAALAPRLSASGDVFNRQGRRAWASVNFITAHDGFTLNDWASYNDKHNEANGEDNRDGHSDNRSWNCGAEGPTDDETILSLRERQKRNMLATLLLAQGTPMLLAGDEFGRTQNGNNNAYCQDNEISWVHWDHDEAAQHLRAFTQRLLELRRTTPTLRRSRFLTGQYDETLDVRDVTWINANGGEMQQEHWDDSNVKCFGMLLDGRAQTTGIRRLGEEATVLLVLNGFDGMVEFTLPEVPHGTKWSLLIDTNLPHGVPDEEFECGAAYQVTARSVLLFKLGK

SEQ ID NO: 28337 - protein, 339 aa, Arabidopsis thaliana
MGEAVEVMFGNGFPEIHKATSPTQTLHSNQQDCHWYEETIDDDLKWSFALNSVLHQGTSEYQDIALLDTKRFGKVLVIDGKMQSAERDEFIYHECLIHPALLFHPNPKTVFIMGGGEGSAAREILKHTTIEKVVMCDIDQEVVDFCRRFLTVNSDAFCNKKLELVIKDAKAELEKREEKFDIIVGDLADPVEGGPCYQLYTKSFYQNILKPKLSPNGIFVTQAGPAGIFTHKEVFTSIYSTMKQVFKYVKAYTAHVPSFADTWGWVMASDHEFDVEVDEMDRRIEERVNGELMYLNAPSFVSAATLNKTISLALEKETEVYSEENARFIHGHGVAYRHI

SEQ ID NO: 28338 - protein, 440 aa, Robiginitalea biformata
MDPKKTFDIPSLGPARFPSPLQLSNNSGDDLFNFVRESDRVLVDVSLSGFQQARESGSRPECLEKSGPRETIFFDPGKTTAAIVTCGGLCPGINNVIRSLVMALHYFYGVKRIIGVRYGYEGLSRDCPHEFMELTPDKVKDIHEFGGTILGSSRGAHPVSEMVDTLVENRIDILFTVGGDGTLKGAHAIGDEIAKRGLNIAVAGIPKTIDNDINLIDKSFGFETAFDVASPIVRDAHNEAIGAFNGISIVKLMGRDSGYIAASTALAMPVVNFVLVPEMPLKLEGEGGFLQALEDRLQRKHHAVIVVAEGAGQHLFDDDRRVTDASGNVKHKDIGILLKDRIQEHFGQSGTPVTIKYIDPSYIIRSAPANANDSLFSNRLAYQAVHGAMAGKTQFVAGRVHNRFVYLPISKVTDRRKKIDMEGEFWFAVLQSTGQPFKMG

SEQ ID NO: 28339 - protein, 339 aa, Arabidopsis thaliana
MGEAVEVMFGNGFPEILKATSPTQTLHSNQQDCHWYEETIDDDLKWSFALNSVLHQGTSEYQDIALLDTKRFGKVLVIDGKMQSAERDEFIYHECLIHPALLFHPNPKTVFIMGGGEGSAAREILKHTTIEKVVMCDIDQEVVDFCRRFLTVNSDAFCNKKLELVIKDAKAELEKREEKFDIIVGDLADPVEGGPCYQLYTKSFYQNILKPKLSPNGIFVTQAGPAGIFTHKEVFTSIYNTMKQVFKYVKAYTAHVPSLADTWGWVMASDHEFDVEVDEMDRRIEERVNGELMYLNAPSFVSAATLNKTISLALEKETEVYSEENARFIHGHGVAYRHI

SEQ ID NO: 28340 - protein, 114 aa, Xanthomonas campestris
MRMKLITAIIRPFKLDEVREALSAAGVSGITVTEVKGFGRQKGHTELYRGAEYVVDFLPKIKIETVVTDDRLDAVVEAIQNAAGTGKIGDGKIFVTAIEQVVRIRTGEIGADAL

SEQ ID NO: 28341 - protein, 597 aa, Gibberella zeae
MASLTSGEYPPTLKAEEKDALIETVKDWSIGNGLAVRPPPTVIAAEADPKGIAATNVPVTLFPSPFPSQCFSQGKAVQKTYNELYASVSRDEEFLAQVVKEVADGDEFIRNLWDVHTKVKAEGYTQARIYTLGETADLSQEFKADSDRYLATTEYPILENSITQGSLDLPENTSTRGLAAGIEAAYNVSPQSELGHQKCVIFLVQDGERNIFDQRHLEYQIIKSSPSIPVFRLPYSQILKHTKIAETSKRQLLYHLPRNPTKVYEVAVIYMRSGYGPSDYPDQQAWDARYHLERSNAIKCPTVLTQLAGTKKVQQILATPRPSSSPSALSRFIRDDTDDAAELWRTFTNIYPMDTSDAGLEARKKALDPKACQDYVLKPQREGGGNNIYRGAIPGFLKSVPESHWGSYILMELITPPPVNNIILRNGNLEQGGVICELGIYGTCVWDQITGKVHHNEEAGYLLRTKGDKSEEGGVAAGFGSSQHFGAHPMYSYTDPTATGPSTAFLLDIAMVASNRGLLVVNAYINRLYNIDTQYRPVGQADTPFRTLVLSTDSFLHSTASFATDAHPRAMFSTPVGKAHGYSGKPTGGDSSYCVFC

SEQ ID NO: 28342 - protein, 339 aa, Arabidopsis thaliana
MGEAVEVMFGNGFPEILKATSPTQTLHSNQQDCHWYEETIDDDLKWSFALNSVLHQGTSEYQDIALLDTKRFGKVLVIDGKMQSAERDEFIYHECLIHPALLFHPNPKTVFIMGGGEGSAAREILKHTTIEKVVMCDIDQEVVDFCRRFLTVNSDAFCNKKLELVIKDAKAELEKREEKFDIIVGDLADPVEGGPCYQLYTKSFYQNILKPKLSPNGIFVTQAGPAGIFTHKEVFTSIYNTMKQVFKYVKAYTAHVPSFADTWGWVMASDHEFDVEVDEMDRRIEERVNGELMYLNAPSFVSAATLNKTISLALEKETEVYSEENARFIHGHGVAYRHI

SEQ ID NO: 28343 - protein, 414 aa, Geobacter metallireducens
MGATTEQSNGNILIIEDSPTQSAQLRHIMETNGYHVISACNGREALALLSGQTPSLIISDVIMPGIDGYELCRRIKEREDSRNIPVILLTSLSDPHDVIRGLECGADNFITKPCNEKHLLSRVSYLLESRNPCQIEARSGLEILFGGERYCITADRRQILDLLLCTYETAIQKNDALIRAQDELSRLNQQLETTNRELEAFNYTVSHDLRSPLTNISGYCQVLQELHGDTLDPTCQDYIQEIYRATMRMNDLIGDLMEFSRLNHQELQRQEVNLSTMARIIAVELKSKDRERRVEFRIADGIVGNGDSRLLQLVLVNLLGNAWKYTGKKENAVIEFGVTNTEGKEVYFVRDNGAGFDMAEAHRLFGTFQRLHSKQEFEGTGIGLATVQRIIQRHGGSIRGEGEVGKGATFYFTL

SEQ ID NO: 28344 - protein, 349 aa, Triticum aestivum
  misc_feature (66)..(66): Xaa can be any naturally occurring amino acid
  misc_feature (256)..(256): Xaa can be any naturally occurring amino acid
MDGGVAAAAAAAAAASTVTTAVAPPGAAGAGAPPPFLMKTYDMVDDPATDAVVSWGPANNSFIAWXNTPEFARDLLPKYFKHNNFSSFVRQLNTYGFRKVDPDKWEFANEGFLRGQKHLLKTITRRKPSHANNQVQVPQQQPQQQHQQQPQLQNAPMPSCVEVGKFGMEEEIEMLKRDKNVLMQELVRLRQQQQTTDHQLQTLGKRLHGMEQRQQQMMSFLAKAMQSPGFLAQFVQQNENSKRRLVAAHKKRRLPXPDDGLNSESALLDGQISSITYDLRSTKPCLGKSCTRILPNRIESMVHQIIFSGTCFPVPNFDSLYNPNFGSPFKVPGNLGCLIAQNLRFNIWV

SEQ ID NO: 28345 - protein, 251 aa, Thermoplasma volcanium
MYIVGAGPGDPELLTLKAYNILRKAGVVIYAGSLVNPEILKYANPSAEIYNSAEMDINKIMDISIILIAEGKDVVRLHSGDPHLYGALMEQLSLLREKGIDFEVIPGVSVLTSAAASLGIELTMDNISQSVIIARGSLRIPVPEKQSILALSSHQSTMVIFTAIHIIEKVVEDLLKGGYPKDTPVGVVYHSTWKDEKVIRGTLEDIVQKVKDNRIYRTAIIVVGKVVNPERVYSTKLYDPSYTHSFRRGSS

SEQ ID NO: 28346 - protein, 300 aa, Saccharomyces cerevisiae
MVNNSQHPYIKDGWFREINDKSFPGQAFTMTVDSILYEARSEFQDILIFRNKVYGTVLVLDGIVQCTEFDEFAYQEMITHIAMFAHSNPKRVLIIGGGDGGVLREVAKHSCVEDITMVEIDSSVIELSRKFLPTLSNGAFDDERLDLKLCDGFKFLQDIGASDVHKKFDVIITDSSDPEGPAEAFFQERYFELLKDALNPNGVVIMQSSENFWLNLKYLHDLKNTAKKVFPNTEYCYTMVPTYTSGQLGLIVCSNNANIPLNIPQRKISEQEQGKLKYYNPQIHSSAFVLPTWADKVINE

SEQ ID NO: 28347 - protein, 321 aa, Mannheimia succiniciproducens
MIKKIAVLTSGGDAPGMNAAIRGVVRSALFEGLEVFGVYDGYYGLYHNKIKQLNRYSVSDVITRGGTFLGSARFPEFKNPEVRAKCAEILRSHGIDALVVIGGDGSYTGAKLLTEEHGIQCIGLPGTIDNDAPGTDYTIGYQTALETAVDAIDRLRDTSSSHQRISIVEIMGRHCSDLTINAALAGGCEYIVASEVEFDQEELIQQIERSIANGKRHAIIAITELITDVHELAKRIEERVHHETRATVLGHVQRGGSPCAFDRILASRMGVYAVDLLLQGKGGYCVGIQNEQLVHHDIIDAINNMRRSFKAELLDMNERLF

SEQ ID NO: 28348 - protein, 406 aa, Clostridium perfringens
MNKEIKLRNDIYSVGVMDNRPVPFHRLILEKGTTYNSYLLKTRKPTVIDTVDLIYTKDFLNNLKEIIDLKDISYIVINHTEPDHSGALGGLARQAINAKIVCSEKAVYHLKELYKLHDRDFIVVNDGDTLDIGGKTLLFKMTPYLHTEETMITYDVEDKILFPCDIFSTHLTAKEHFSSKSNEDIKEDFLTYYKLIMKPHRKYIRPLIDILKDLDIEVIAPSHGYILDENIQSYIDIYDKYSKETKKGKKATIVYTTMRNATKKIAEKFKSELENEDIEVYIFNADKSTKKDILASIKESDSILFGTSTKYGDLIGSIEDILKELPKLDLSNKLLGAFGSFGWSGEPIEIIQDYLNSTNGNVLNTSSIIKSTGMIDVHFPVRIRFSLNEESEKEVVRAADYISSII

SEQ ID NO: 28349 - protein, 123 aa, Methanosarcina barkeri
MKEITAVVRPNKMSATKDALDKIGYPSITAIPVLGKGKQRGISGELNFYIQPRLLAKRYSTGMKYIPKRLLSIVVNDEEVDQVIKTIIEVNQTAQIGDGRIFVESIDEVIRIRTGEKGKLALK

SEQ ID NO: 28350 - protein, 334 aa, Chlamydia trachomatis
MKETIAYLGMGMWGFSLANLLANNGHRVVGWARNPALIEQLSVQRRHPAAPHISIPQNLSFTSHMEEALDGATMIVEGVTSAGMRPVLTQLKALTELRVPLVITSKGIEQNTGLLLSEIALEIFGRPAAQHLGYLSGPSIASEVLRGCPCSVVISAYNPDTLKQIHRAFLTPTFRVYPNSDLKGVALGGALKNVIAIACGISDGFRFGDNAKSGLVTRGLHEIRKFATIMGCRPDTLNGLAGLGDLCTTSFSAFSRNTLFGKLLAEGLTPEQAKTKIGMVVEGVYTALSAHQIATHHRIDMPITTSVYRVLYENLDIQEGIAQLLQRDTKEEYL

SEQ ID NO: 28351 - protein, 275 aa, Xanthomonas campestris
MPQVTMRQMLEAGVHFGHQTRYWNPKMAPYIFGARGKIHIINLEKTVPLFNDAMNFLSSIAQKRGTVLFLGTKRSARESIKEEAERCNMPFMTQRWLGGTLTNFRTVKQSVARLKELEAAETDGTFEKLVKHEVLGLRREREKLDASLGGIKEMNRLPDAIFVIDIGHEDIAIKEAKKLGIPVIAVVDTNYDPALVDYAIPGNDDAIRAVQLYARAAADAVLEGKAAAPNSASVREEEFSAEAGDEGKGRRAPAKKATEKKADAPAAAPEAPAAE

SEQ ID NO: 28352 - protein, 536 aa, Streptococcus mutans
MQKHWWHKATVYQIYPKSFMDTNGDGIGDLKGITSKLDYLQKLGVMAIWLSPVYDSPMDDNGYDIANYEAIADIFGNMADMDNLLTQAKMRDIKIIMDLVVNHTSDEHTWFIEAREHPDSSERDYYIWCDQPNDLESIFGGSAWQYDDKSDQYYLHFFSKKQPDLNWENANLRQKIYDMMNFWIDKGIGGFRMDVIDMIGKIPAQHIVSNGPKLHAYLKEMNAASFGQHDLLTVGETWGATPEIAKQYSNPVNHELSMIFQFEHIGLQHKPEAPKWDYVKELNVPALKTIFNKWQTELELGQGWNSLFWNNHDLPRVLSIWGNTGKYREKSAKALAILLHLMRGTPYIYQGEEIGMTNYPFKDLNELDDIESLNYAKEAFTNGKSMETIMDSIRMIGRDNARTPMQWDASQNAGFSTADKTWLPVNPNYKDINVQAALKNSNSIFYTYQQLIQLRKENDWLVDADFELLPTADKVFAYLRKVREERYLIVVNVSDQEEVLEIDVDKQETLISNTNESAALANHKLQPWDAFCIKIN

SEQ ID NO: 28353 - protein, 356 aa, Oryza sativa
PTRPASRVVNKKPPRRSLNVSGPVQPYNPSLKNFWYPVAFSSDLKDDTMVPIDCFEEQWVIFRGKDGRPGCVMNTCAHRACPLHLGSVNEGRIQCPYHGWEYSTDGKCEKMPSTKMLNVRIRSLPCFEQEGMVWIWPGNDPPKSTIPSLLPPSGFTIHAEIVMELPVEHGLLLDNLLDLAHAPFTHTSTFAKGWSVPSLVKFLTPSSGLQGYWDPYPIDMEFRPPCMVLSTIGISKPGKLEGKSTKQCSTHLHQLHICLPSSRNKTRLLYRMSLDFAPWIKHVPFMHILWSHFAEKVLNEDLRLVLGQQERMINGANVWNWPVSYDKLGIRYRLWRDAIERGVDRLPFSNQSESGS

SEQ ID NO: 28354 - protein, 282 aa, Marchantia polymorpha
QLTESDIMIPIESFEEPWVLFRGKDGRAGCVRDECAHRACPLSLGTVVDGRIQCPYHGWEYNTGGKCEKMPSTRPLKTGIRALPCIEQDGMVWIWPGDETPAATLPSLLPPENYTIHAEIVLELPVEHGLLMENLLDLAHAPFTHTSTFAKGWSVPNMVKFKTPMQALSGNWDPYPIDMAFQPPCMVLSTIGLVKPGKLDGSSTASCSKHLHQLHVCMPSSRGKTRLMYRWLWTLPNGRSMPYIDRVWTHLANQVLNEDLRLVEGQQDRMKRGANVWQTPVG

SEQ ID NO: 28355 - protein, 467 aa, Mannheimia succiniciproducens
MTKIVSVAEVLQGRTAIGEKVTVRGWVRTRRDSKAGLSFLAVYDGSCFDPIQAIINNDIVNYESEVLRLTTGCSVIVTGTVSKSPAEGQAVELQAETVEVVGWVEDPDTYPMAAKRHSIEYLREVAHLRPRTNIIGAVARVRHCLAQAIHRFFNEQGFYWVATPLITASDTEGAGEMFRVSTLDLENLPRDDKGAVDFSQDFFGKESFLTVSGQLNGETYACALSKVYTFGPTFRAENSNTTRHLAEFWMVEPEVAFATLADNAKLAEDMLKYVFNAVLKERMDDLKFFEKHIDKDVINRLERFVASDFAQIDYTDAIDVLLKSGKKFEFPVSWGIDLSSEHERYLAEEHFKSPVVVKNYPKDIKAFYMRLNEDGKTVAAMDVLAPGIGEIIGGSQREERLDVLDARMAEMGLNPEDYWWYRDLRKYGTVPHSGFGLGFERLIVYVTGLQNIREVIPFPRTPRNANF

SEQ ID NO: 28356 - protein, 320 aa, Unknown
  Acidovorax sp. JS42
MSGAPTAQATRYVAERLNADFGFYLSDRRLLAERQSAWQHIEVFDNPQFGRVMRIDGCFMTSERDEFFYHEPMVHLPAIAHPGVRRALVVGGGDGGAAEELLKLPGIEQVVLAELDGEVIAMARDWLGQIHRGAFDDPRLEVRLGDARAFIGQTEERFDQIVLDLTDPFGPAVELYTVEFYAACRRALNPGGVLSLHLGSPVHLPESLGRIAASVRAVFPIFRPYLQYVPLYGTLWCMGMASDSTDPARLSADEVDARIAARGLGDLQLYNGAVHHALLAQPNFVRALLDRPALPLHSGDVLEEVRDPAELPEVVVSAAA

SEQ ID NO: 28357 - protein, 164 aa, Nocardia farcinica
MAEMSIRDIPLRTLSGADTTLAELVGDKAVLLVNVASKCGLTPQYSGLVELHRSYGERGFSVVGVPCNQFMGQEPGTAEEIEQFCSTTYGVDFPLLEKTEVNGENRHPLYAELTQVADAEGTAGDIQWNFEKFLIDRDGKVAGRFRPRTEPQDPALVAALEGVL

SEQ ID NO: 28358 - protein, 471 aa, Bacillus cereus
MNQQIEQTDLKRTMKSRHLFMIALGGVIGTGLFMGSGQIVHNAGPGGAILAFLVGGFVMYLTMLCLGELSVAMPEAGSFQSYASKFISPGFGFVVGWMYWLNWAVTVGVELTTVSILMKRWFPDVSSWIWCVTFAAALFLVNALSAKAYAEAEFWFASVKVATIVIFIVLGGAVMFGLLDFNGKPAPMLHNFTENGGLFPNGALAVLLTMITVNYSFQGTELIGIASGESENPEKTIPKAIKNTIWRTLFFFVLAISVVVGLLPWQEANLVESPFVLVFDVAGVPYAADIMNFVIITAVLSVANSGLYANSRMLWAMAKQGMASPAFTKLTKKGVPLNALIFSLIFASLSLLTSVFAADTVFLVLTSIAAMAAVVVWMSIAASQFFFRRNFVKNGGNINDLKYRTPLYPLVPIVAFSLNFITFVSLAFIPDQRIALYCGIPFMIICYILYQVKYKKIVTLEQPRTVIREIN

SEQ ID NO: 28359 - protein, 462 aa, Unknown
  Shewanella sp. MR-4
MGKLSIKKWLIFSAMLVAVLLAMFPLKQHPALFSYSASVVLITLLFWSTGFIPPFMAGLIFFALATIFKLIDPSALFSGFGSAAVWLIISGFVIGGAISESGLSRRLAALIAPALTMSYQRMIAGLVISAMLLGFVMPSSVGRAVVMLPIGMALAEQLGFSRGSNGRIGIATALALACNMPSLAVLPANIPNMILAGASENLFNVHFGYAEYLFLHFPILGLLKSAIIVALVVYLFPAKIDKTQMAAATDIEAYDVVKQVKLGVLLVITLLFWITDSWHGINPAWVGLTTAIILLLPKWGIIEPKRFNQSVDFSTVIFVAAALGLGVLVNQSGLGSELGQVFSQYLPLSQGGSFLNFMSLSLISTLTGLVATVPGVPTVLTPMAADLANATGFYLPAVLMTQVIGFSTVIFPYQAPPLILAMQLSQESLAHLLKVTLPLALITLLVLMPLDYLWWQLLGWIS

SEQ ID NO: 28360 - protein, 519 aa, Corynebacterium efficiens
MSGLEQPAELSRVWRWLLLVSVAICAASGLVYELALVSLSASLNGGGIVETSLIVAGYVAALGVGAILVKPFLRWPAQTFLAVETLLGLIGGLSALVLYMTFAVVGQNLWMLVLATALIGILVGAELPLLMTMIQRGRLADARTTGSLVATLNAADYLGALLGGLAWPFILLPWLGMMRGAAAAGMINLLAALFVGCVLLRHLLPRAQFIRAVVALLVAIAVLGTVLVRSDGIVATARQQLYRDPVIYAHQSDYQDIVVTQRGADRRLYLNGGLQYSTRDEHRYTESLVYPGLSDSARTALIIGGGDGLAARELLRFPDMRITQVELDPEVIEVANTILLPDNGGAMQDPRVTVITDDAFTWLRAGGDGGQRYDAIFVDLPDPNNDTMARLYSQEFYTLALARLNDGGRMVVQSSSAYTTPDVFWRIASTMSAAGCGAVIPYHVHVPTFGDWGFQLCGPEGTELGLRGDTPSLRFLTDEVLAAAGVFGADNQPRELEPSTLDHPRVVEDLRRGYRQAGE

SEQ ID NO: 28361 - protein, 519 aa, Novosphingobium aromaticivorans
MPVLDAATTAQLKAYLGNLRRPIELVATLDDSPKSAEMRSLVEEIVAQSDKVSARFDGTGERVPSFAIRADEGRAQAVFAGLPMGHEFTSLILALLHVGGHPPKEDADLLDQVRGLEGPLHFETFFSLTCQNCPDVVQALNIMAALNPNVSHVAIDGALFKDEVERRQIMAVPTVYLNGELFGSGRMDLAQIVAKLDTNASARAAEKIAAKEPFDVLVVGGGPAGAAAAIYAARKGIRTGVVAERFGGQVLDTMGIENFISIQHTEGPKLAAQLEQHVKEYDVDVMNLQRATGLVPAGDDGLHEVKLENGASLKAKTLILSTGARWRQMGVPGEDEYRNKGVAYCPHCDGPLFKGKRTAVIGGGNSGVEAAIDLAGIVAHVTLIEFDNQLRADAVLQTKLRSLPNVTIVTSALTTEVLGDGAKVTGLVYKDRETGQTHTVELEGIFVQIGLVPNTEWLKGAIDLSPRGEIEVDARGATSVPGVFGAGDATTVPYKQIVIAMGEGSKAALSAFDYLIRQG

SEQ ID NO: 28362 - protein, 255 aa, Streptococcus pyogenes
MAVISMKQLLEAGVHFGHQTRRWNPKMAKYIFTERNGIHVIDLQQTVKLADQAYEFVRDAAANDAVILFVGTKKQAAEAVADEATRAGQYFINHRWLGGTLTNWGTIQKRIARLKEIKRMEEEGTFDVLPKKEVALLNKQRARLEKFLGGIEDMPRIPDVMYVVDPHKEQIAVKEAKKLGIPVVAMVDTNADPDDIDIIIPANDDAIRAVKLITAKLADAIIEGRQGEDADVAFEADTQADSIEDIVEVVEGDNA

SEQ ID NO: 28363 - protein, 531 aa, Unknown
  Shewanella sp. MR-4
MSADQQTVTPLENFSPKVAQRAVHRVQPELNFWQIFNMCFGFLGIQFGFALQNANVSRIFQTLGASIDDIPILWIAAPLTGLLVQPIIGYLSDNTWGRLGRRRPYFLIGAICTTLAIFVMPHSPTLWIAAGMLWIMDASINIAMEPFRAFVGDNLPPKQRTQGYAMQSFFIGIGAVVASALPYILSNFFAVANTAPAGEIADSVRYAFYFGGAVLFLSVAWTVVSTKEYSPDELAAFHGNADAGIDEQQNRTRTHKNYQSAAIVWMAVGALLTLAVWTQDLDKQLYILTLGIFAFGPLQLYCALRLGKSSPSQRAQLGIVFNVVDDLFHMPKAMHQLAIVQFFSWFALFAMWIYTTSAVTSYHFGSSDVLSKAYNDGADWVGVLFASYNGFSAIAALFIPLLAKRIGIKLTHTFNMFCGGFGLISFYFIKDPSLLWLPMIGVGIAWASILSVPYAMLSGALPPKKMGVYMGIFNFFIVIPQLLAASVLGLILNGLFDGQPIYALITGGVLMLCAGIAVLFVEQPNTQHTQA

SEQ ID NO: 28364 - protein, 362 aa, Glycine max
MVLVRVVPMASSSSIRPTLSSLRFLTPSSLSLSNPSSRISFSHLPSPSVSQSNSFGLKASRELRQHGNSTRIMASGHVSQSISAASPENVLEWVKQDKRRMLHVVYRVGDLDRTIKFYTECLGMKLLRKRDIPEEKYTNAFLGYGPEDSHFVIELTYNYGVDKYDIGTGFGHFGIAVDDVAKAVELIRAKGGKITREPGPVKGGRSVIAFIEDPDGYKFELIERGPTPEPLCQVMLRVGDLNRSIEFYEKAFGMELLRTRDNPEYKYTIAMLGYGPEDKSTVLELTYNYGVTEYDKGNAYAQIAVGTDDVYKTAEAIKLAGGKITREPGALPGINTKITACLDPDGWKSVFVDNVDFLKELE

SEQ ID NO: 28365 - protein, 495 aa, Geobacter sulfurreducens
MNKKRSPKTVLAAGPSSKRGDLIELAVTALDEDGNGIGTHDGTNVHVIGALPDERVRARLTHVGKRHLHAEAVEVLTPSRARLAQPSCKRAGSCDGCPLIVMHYPDQLNWKRTFTERQIRRYQTLGAAEVLATLPSPNQLHYRNSAKLVVSGTFRRPVIGIYRRNSHQVMDIGTCPLHHPLINRVVTAVKEGIAKCKVQVYNPRTGSGLLRYLVVRISERTGTAMAVFVTVERNYNEIHHLAKHLQQSVPQVEVVVQNVNSSEGNVILGQRDYFLTRQHALTEELGGIRFTISPRSFFQVNSGGARIIYETVRQWSSLTGKESVVDLYCGIGGIALFLAGTAREVHGIEVVEAAVNDAESNARLNRIHNCSFEAGDAAELIEELVEEGERLDLVVLNPPRKGCDAGVLNKVAAAGPARIVYVSCAPATLARDLDILAGLGYATLRVQPVDMFPQTPHVENIALLVKKLPRNDRLESPAKERSRPRASHKAKGGAV

SEQ ID NO: 28366 - protein, 169 aa, Brassica napus
MADESPKSIYDFTVKDISGNDVSLSQFKGKTLLIVNVASKCGLTDANYKELNVLYEKYKEQGLEILAFPCNQFLGQEPGNNEEIQQTVCTRFKAEFPIFDKVDVNGKNTAPLYKYLKAEKGGLLIDAIKWNFTKFLVSPDGKVSQRYSPRTSPLQFEKDIQALLGQASS

SEQ ID NO: 28367 - protein, 469 aa, Bacillus thuringiensis
MEKLQIGVVGVGVMGKSLALNFESKGYSVALYDISKEKVDETIEENRGKNLVGTHIVEEFVNSLESPRKILLMVNAGEITDKAIDSLVPHLDKGDILIDGGNTYFVDTIRRNKRLAEEGINFIGAGVSGGEEGALKGPSIMPGGQKDAYEKVKDMLENISAKVNNEPCCSYIGPNGAGHYVKMVHNGIEYGDMQLICEAYFFLKQTLDLTAEEFHEIFAEWNKGELNSYLIEITADIFKKKDEETGKPLVDVILDTAGQKGTGKWTSQSALDLGISLPIITESVFARCISALKEERVNASKVLSGPKDKTAIGVEKAELIEAVRQALYMSKICSYAQGFTQLKAASEEYDWNLDFGSISMLWRGGCIIRAAFLQNIKEAYETNTDLPNLLLDPYFKEIVESYQGGLRQIISMAVQQGIPIPAFSAAISYYDSYRTAKLPANLLQAQRDYFGAHTYKRVDKEGTFHTKWI

SEQ ID NO: 28368 - protein, 415 aa, Burkholderia mallei
MTEHAGADATAMPRTVVVIGGGQAAGWVVKTLRDEGFAGRIVMIADEAHLPYERPALSKAVLAGEADIATVRVMQPDAFGALDVDAWQPERAASIDRARRVVRTASGREIEYDRLVIATGGTPRRLPDAIVGTAHLHYLRTLDEALALGEKLRASRRVLVIGGGWIGLEVAATARKLGVDALVVEGAPRLCARSVPGAVSDFLLDLHRANGVDVRLNASLASLDAHPDDARRVRATLAGGGVVDADFAVAGIGLALNTSLATEAGLHVDDGIVVDEYGATSDPAIFACGDVANHPNAWLKRRVRLESWANAQHQAIAAAKAVLGVRAPYAEIPWFWSDQYDVNLQILGDLPADARCIVRGELAAKRATLFFVADGALRGVIAINAARELKLARKWMNQGRAIDVAALADTAKALA

SEQ ID NO: 28369 - protein, 523 aa, Chlorella sorokiniana
CRPPSSPSLSWPPGLRSPALPRAVACARGRSAKRDVAAKRLRSRSPRMDATTGDFTALQKAVKQMATKAGTEGLVHGIKNPELRQLLTEIFMKDPEQQEFMQAVREVAVSLQPVFEKRPELLPIFKQIVEPERVITFRVSWLDDAGNLQVNRGFRVQYSSAIGPYKGGLRFHPSVNLSIMKFLAFEQIFKNSLTTLPMGGGKGGSDFDPKGKSDAEVMRLWQSFMTELQRHISYVQDVPAGDIGVGAREIGYLFGQYKRITKNYTGVLTGKGQEYGGSEIRPEATGYGAVLFVENVLKDKGESLKGKRCLVSGAGNVAQYCAELLLEKGAIVLSLSDSQGYVYEPNGFTREQLQAVQDMKKKNNSARISEYKSDTAVYVGDRRKPWELDCQVDIAFPCATQNEIDEHDAELLIKHGCQYVVEGANMPSTNEAIHKYNKAGIIYCPGKAANAGGVAVSGLEMTQNRMSLNWTREEVRDKLERIMKDIYDSAMGPSREYNVDLAAGANIAGFTKVADAVKAQGAV

SEQ ID NO: 28370 - protein, 853 aa, Pseudomonas syringae
MNTTVFPRTDVKTLIVVGNGMVGHHCVEQLIEGGALEHYRIHVFGEESQRAYDRVHLSEYFTGRDAESLAMSEMALYEQAGLTLHLGVPVLEIDRGRHEIITAEGCFCYDKLILATGSYPFVPPIEGAQGNSRLVYRTLEDLDTIRYAASKAKRGVVVGGGLLGLEAANALKSLGLEAHVVEFAPRLMPVQLDEHGGAALKARIEALGVGVHLSRATQSISDGKQYRYRMNFANDEFLETDLIVFSAGIRPQDSLARQCALELGPRGGVAIDEHCRTSDADIYAIGECAAWNGSVFGLVAPGYQMARGVAAQLCGKETDAFFGADMSTKLKLLGVDVGSIGDAHGALAGAVSYRFIDEASGSYRRLVVSADGKQVLGAVLVGDNSYYDTLLQYAQNGITLPADPSSLILPRGEGAPTLGADALPATATICSCHNVSKGSICSAIDNGCTDLAGIKACTKAATGCGGCTALLKQVFEHELIARGVAVDKSLCEHFAYTRQELYSIVRVEGIESFDELLDRHGKGAHGCDICKPAVGSILASCWNRPITEPSLVPLQDTNDTFMANMQKNGTYSVVPRIPGGEITPDGLIAIGAVAKKYDLYTKITGGQRIDLFGAQLHELPDIWSELIAAGFETGHAYGKSTRTVKSCVGSTWCRYGVQDSVAMALRIEDRYKGLRSPHKLKFAVSGCTRECAEAQSKDVGVIATENGWNLYLCGNGGMRPRHAELFATDLDDETLIRYIDRFLMLYIRTADKLQRTSVWRKTLEGGLDYLKAVILDDSLGLAAELESQMQLVVDRYECEWANALKDPEKLKRFRTFVNDGRSDPDVHFVKERAQRRPAKPEELALIPLFKEVV

SEQ ID NO: 28371 - protein, 319 aa, Geobacillus kaustophilus
MKRIGVLTSGGDSPGMNAAIRAVVRKAIYHGVEVYGIYHGYAGLIAGNIKKLEVGDVGDIIHRGGTILYTARCPEFKTEEGQKKGIEQLKKHGIEGLVVIGGDGSYQGAKKLTEHGFPCVGVPGTIDNDIPGTDFTIGFDTALNTVIDAIDKIRDTATSHERTYVVEVMGRHAGDIALWSGLAGGAETILIPEADYDMDDIIARLKRGHERGKKHSIIIVAEGVGSGVDFGRQIQEATGFETRVTVLGHVQRGGSPTAFDRVLASRLGARAVELLLEGKGGRCVGIQNNQIVDHDIAEALAKTHTVDQRMYTLSKELSI

SEQ ID NO: 28372 - protein, 185 aa, Geobacter metallireducens
MSVTLDEVKQVYAEADCLYTAPQVEETIDRMAREITARLADANPVVFCVMKGGIIVTGKLLPKLEFPLEAEYLHATRYGHKLYGTVLDWKVRPTKELKDRTVLIIDDILDEGETLGAIADWCRGMEAKEVLTAVLIDKEHDRKARPDLVPEFVGLRTPDRYLFGFGMDYKGYWRNAPGIFALKGY

SEQ ID NO: 28373 - protein, 83 aa, Triticum aestivum
SNRPQASVNRRDVTRNLFSTRKYYRTLRWRPGGTVFVNIATTLTCNPIIFWGRYGTTIAISGPIHVVGGRPLETDQKSSGYQR

SEQ ID NO: 28374 - protein, 306 aa, Unknown
  Mycobacterium sp. JLS
MSANTKWTAADVPDQEGRVAVITGANTGIGYEAAAVLAAKGAHVVLAVRNTDKGGAAAERIRSALPHADVTVRELDLTSLDSIRAAADGLRADYPRIDLLINNAGVMMTQKGTTKDGFELQLGTNHLGHFALTGQLLDNLLPVEGSRVVTVSSNAHRWGRVNFDDLQSERSYNRVTAYGQSKLANLLFTYELNRRLSAKGAPTIAVAAHPGTSSTELTRNLWPVARRPVELVWGLVSQTPEMGALPTLRAATDPDVRGGQYYGPDGIGEQRGHPKLVQSNARSYDEAAQRGLWSVSEELTGVTFPV

SEQ ID NO: 28375 - protein, 424 aa, Burkholderia mallei
MSNANPFFSQSLAERDASVRGAILKELERQQSQVELIASENIVSRAVLDAQGSVLTNKYAEGYPGKRYYGGCEFADEVEALAIERVKRLFNAGHANVQPHSGAQANGAVMLALAKPGDTVLGMSLDAGGHLTHGAKPALSGKWFNALQYGVSRDTMLLDYDQVEALAQQHKPSLIIAGFSAYPRKLDFARFRAIADSVGAKLMVDMAHIAGVIAAGRHANPVEHAHVVTSTTHKTLRGPRGGFVLTNDEEIAKKINSAVFPGLQGGPLMHVIAGKAVAFGEALTDDFKTYIDHVLANAQALGDVLKAGGVDLVTGGTDNHLLLVDLRPKGLKGAQVEQALERAGITCNKNGIPFDPEKPTITSGIRLGTPAGTTRGFGAAEFREVGRLILEVFEALRTNPEGDHATEQRVRREIFALCERFPIY

SEQ ID NO: 28376 - protein, 467 aa, Arabidopsis thaliana
MEGRRITASPRPCSGRRIVAKKRSRPDGFVNSVKKLQRREISSRKDRAFSISTAQERFRNMRLVEQYDTHDPKGHCLVALPFLMKRTKVIEIVAARDIVFALAHSGVCAAFSRESNKRICFLNVSPDEVIRSLFYNKNNDSLITVSVYASDNFSSLKCRSTRIEYILRGQPDAGFALFESESLKWPGFVEFDDVNGKVLTYSAQDSVYKVFDLKNYTMLYSISDKNVQEIKISPGIMLLIFKRAASHVPLKILSIEDGTVLKSFNHLLHRNKKVDFIEQFNEKLLVKQENENLQILDVRNAELMEVSRAEFMTPSAFIFLYENQLFLTFRNRNVSVWNFRGELVTSFEDHLLWHPDCNTNNIYITSDQDLIISYCKADTEDQWIEGNAGSINISNILTGKCLAKITPSSGPPKDDESSSSNCMGKNSKQRRNAVAEALEDITALFYDEERNEIYTGNRHGLVHVWSN

SEQ ID NO: 28377 - protein, 305 aa, Bacillus thuringiensis
MKLCENVTELIGDTPVVRLSKFIPEDAADVYVKLEMFNPSRSVKDRAAYNLLHVAEENGLIKPGDTIIEPTSGNTGIGLAMNAAAKGYKAILIMPDNMSKERINLLKAYGAEVVLTPAEQRMPGAIAKALELQKQIPNSFIPQQFENPANPNIHRYTTALEIYEQMDGELDAFVATAGTGGTITGTGETLKEKLPNLYIAVVEPKGSPVLSGGVPGPHKLVGTSPGFIPKNLNTEVYNEIIQIADEEALTTMRNLARQEGLLVGPSSGASVYAAIMIAKRLGTGKKVLCVAPDTGERYLSMGLFE

SEQ ID NO: 28378 - protein, 339 aa, Arabidopsis halleri
MGEAVEIMFGNGFPEIHKDTSPIQTLHSNQQDCHWYEETIDDDLKWSFALNSVLHQGTSEYQDIALLDTKRFGKVLVIDGKMQSAERDEFIYHECLIHPALLFHPNPKTVFIMGGGEGSAAREILKHTTIEKVVMCDIDQEVVDFCRRFLTVNSDAFCNKKLELVIKDAKAELEKREEKFDIIVGDLADPVEGGPCYQLYTKSFYQNILKPKLSPNGIFVTQAGPAGIFTHKEVFTSIYNTMKQVFKYVKAYTAHVPSFADTWGWVMASDHEFDVEVDEMDRRIEERVKGELMYLNAPSFVSAATLNKTISLALEKETEVYSEENARFIHGHGVAYRHI

SEQ ID NO: 28379 - protein, 801 aa, Staphylococcus aureus
MAKQKLVMIGNGMAGIRTIEEILERANDLYDITVIGKEPYPNYNRIMLSNILQNKMTVEETIMNPYEWYEEHGIELITNDPVIEVDRANQSVTTANGIEVSYDKLIFATGSKAFVIPVPGSTLPSVIGWRTIDDTEQMMNIAKTKKKAIVIGGGLLGLECARGLLDQGMEVTVLHLAEWLMEMQLDRKAGNMLKADLEKQGMKFEMQANTTEILGEDDVEGVKLADGREIPADLVVMAVGIRPYTEVAKESGLDVNRGIVVNDVMQTSDSNVYAVGECAEHNGKVYGLVAPLYEQGKVLADHLTNKETNGYKGSTTFTSLKVSGCDLYSAGQIVENAEIKGIEIFNSVDNNYKKIFLKDGNVVGAVLYGDIDDGSRFYNMMKKGESTEDYTLVSLLTKGGEEASLSIADMADDETICGCNGVDKGTIVNAITENGFTTVEEVTAKTKAGNSCGKCKPQIAQILQHTLGDDFVAAKPAGICGCTDLTRDQIVTQIRAKGLKTSKEVRHVLNFKNKGGCPKCRPAINYYLNMVYPHDHEDERESRFANERYHANIQNDGTFSVIPQMRGGVTDADQLIRLGEVAKKYHVPLVKVTGSQRVGLYGVKKEELPNIWEDLGMRSASAYGKKTRSVKSCVGKEFCRFGTQYTTRLGIRLEKTFEYIDTPHKFKMGVSGCPRSCVESGVKDFGIISVENGFQIYIGGNGGTEVEKAEFLTTVETEDEVIKLCGALMQYYRETGIYAERTAPWLRRLGFENVKEVLLDPERQNELFERIMDAKKAVEAEPWEAITSNAQARKIFEVEKV

SEQ ID NO: 28380 - protein, 480 aa, Oryza sativa
MALKLLWLHADGHCQCHLSLLLRLVACLALVLLLPPPPPAQAATVVTHLPGFDGPLPFYLETGYVGVEEETGTELFYYFVESERSPRSDVVLLWLSGGPRCSVFSGFVYEIGPVMFVAERYSGGTVPRLEYNPYSWTKLASILFVDSPVGSGFSYAHDPKGYDVGDISSSMQIVKFLRKWLDDHPKYLSNPFYIGGDSYAGKVVPLITQYLSEGIEEMRHPIINLKGYLVGNPSAGDKIDVNSRVPYSHSFGVISDQLYEAALANCKGDYENPTNKPCTDVMQTINNLMSEVLEPACPFDWPWPMPGRDASNRKSLTEEHYWLGDPPVEPPFSCFAAYRYYLSYFWANDNATRAALGIKEGTVTEWIRCPTGLPYTRDLPSSIECHFNVTTRGYRALVYSGDHDPIVPFSGTQAWIRSLNFSIVDDWRAWHLDGQAAGFTIKYANNLTFATIKGGCHIPPENRPKESFIMAKRWLAGGPL

SEQ ID NO: 28381 - protein, 266 aa, Glycine max
  misc_feature (21)..(21): Xaa can be any naturally occurring amino acid
  misc_feature (34)..(34): Xaa can be any naturally occurring amino acid
  misc_feature (79)..(79): Xaa can be any naturally occurring amino acid
  misc_feature (229)..(229): Xaa can be any naturally occurring amino acid
  misc_feature (241)..(241): Xaa can be any naturally occurring amino acid
SGRRRRSFASLRYGEGGRADXVSPRPVLAAGAWXAKKRPRLVDGFVNSVKKLQRREISSNRDRAFSMTDAHESLRRPPXRFRNIRLQEEYDTHDPKGPSSAVLPFLRKRSKIIEIVAARDIVFALAQSGVCAAFSRETNGRICFLNVSPDEAIRSVLYNKNNDSLITVSVYASDGYSSVKWRSTRIEYIRRANPGAGFALLESESLKWPGFVEFDDVNGKVLTYSAQDXKNVQEIKISPGXIMLLIFAKSSSHVPLKILSIEDGTV

SEQ ID NO: 28382 - protein, 741 aa, Unknown
  Marinobacter sp. ELB17
MLRKLHGWPGLVAALLLLVLATTGVVLSVAPAIERASATIPATGQISVADLAERVVAHYPGTEQIQRSLSGEVIVYYSRDGQPGADLVNPLTGEGIALYQPSAFLRWVKNLHRSFLLDDAGRMVAGGLAVMMLLLCLSGMFLLARRIGGWKAVLKPIAGSGSSRIHAELARFAVIGLLLSALTGSYMSAVRFGLLPEAAAAEPSFPAEVSGGTPAPVNSLIALKNVDASELRELVFPYPDDPSDVYSLNTTQGSGFVDQATGELLQYQPRSAGNQFQHWMIRLHTGEGLWWLGLILGVAALTVPALSFTGIQVWWRRRSTSACLGEGASTEMADVVILVGSEGNTTWGFARDLQKKLNQAGKKVHCAPMNDLAKRYPQASVLFILTSTYGDGDAPSSASQFMTRFEHFQADDGLGFVVLGFGDRQFPKFCQYSLDVDAALSSKGLPQMDFVTRIDRGSAIQFREWGEAIGERMGISLALAHNPAPATTTEFELVERVDYGVAVNAPTSILRFRPVQDRRNLWQVLSFRSRLHLPSFEAGDLFGVAPPEDNTARLYSLASSASDGQLEICVRKQTNGLCSGYLHSLKPGDRITGFIQQNPGFRPAGGATSIILVGAGAGIGPLAGFIRKNTDLSPMHLYWGGRNPQSDFLYQPELGGYLDDHRLTGLNTAFSRSADKAYVQDAIMADETALRQLIEKGAQVLVCGGRDMASGVSQVFDSILKPSHMDVDELRAEGRYLEDVY

SEQ ID NO: 28383 - protein, 387 aa, Triticum aestivum
  misc_feature (221)..(221): Xaa can be any naturally occurring amino acid
  misc_feature (238)..(238): Xaa can be any naturally occurring amino acid
MIPAVKLSPAAFSVTNQRSKSAFVPSVSILNMKKFASCSLRPLYLTRLDDPHTSELKPRRQLLDFRCAASAADDKESKAEVVPASSEAAQKLKISIYFATWWALNVIFNIYNKKVLNAFPYPWLTSTLSLACGSAMMLFSWVTCLVEAPKTDLDFWKALFPVAVAHTIGHVAATVSMSKVAVSFTHIIKSAEPAFSVLVSRFILGESFPMPVYLSLLPIIXGGCGLTAATELNFNMIXGFMGAMISNLAFVFRNIFSKRGMKGKSVSGMNYYACLSIMSLVILTPFAIAMEGPQMWAAGWQKALADVGPNVLWWIGAQSVFYHLYNQVSYMSLDQISPLTFSIGNTMKRISVIVSSIIIFRTPVRPVNALGAAIAIFGTFLYSQAKQ

SEQ ID NO: 28384 - protein, 676 aa, Hordeum vulgare
MFPLGARQPPPSAMDNHQQQQPPRGEHAAQPRCWEEFLHRKTIRVLLVETDDSTRQVVAALLRHCMYQVIPVENGHQAWAYLQDMQSNIDLVLTEVFMHGGLSGIDLLGRIMNHEVCKDIPVIMMSSHDSMGTVLSCLSNGAADFLAKPIRKNELKNLWAHVWRRSHSSSGSGSGSAIQTQKCTKSKSGDDSNNNSNDRNDDASMGLNARDGSDNGSGTQAQSSWTKRAVEIDSPQDMSPDQSADPPEGTCAHVNHPKSEICSNRWLPGTNNKKCQKPKETTNGDGFKGKELEIGAPGNLNTDDQSSPKESSVKPTDGRCEYLPQNNSSDTVMENLEEPIVRAADLIGSMAKNMDAQQAAARAIDAPNCSLQAPEGKDTDGENAMPYLELSLKRSRSTGEGAGPIQEEQRNVVRRSDLSAFTRYNMCAVSNQGGAGFVGSCSPNGDSSEAAKTVAAQMKQGSNGSSNNNDMGSTTKSVVTKPCGNNKVSPINGNTHTSAFHRVQPWTPATAAGKDKADEVSKKNVAAAAAAAKEMGCEAQSKHPCAAADDVNGGSAGGTAQSSVVNPSGPVEGHAANYGSNSFSNNNTNNGSTAATTAAAATVHAETGGGVDKRSNMMNMKRERRVAAVNKFREKRKERNFGKKVRYQSRKRLAEQRPRVRGQFVRQPPAPAAVER

SEQ ID NO: 28385 - protein, 581 aa, Ashbya gossypii
MSSYTCQNNVPSSIPLAEYLFHRLRQLGVTTGFGLPSDYNMFLLDGLENVADMHLCCNTNELNASYAADGYARMQRLSCLVSTFGVGELSVVNGIAGSFAEHVAVLLIVGMPPASAQRRKLLLHHTLGNGDYDVFRRLASDICTYSTVVRSAHTAAEVLDHCIARCYRDQKPVYCGVPINLAEAMLPSAPLDVPLPLLDEPCAPLDELVALLLDKIYAAKHPVLVVDACVARHGCMQQLQRLAQATDFPVCCTPMGKGIVDEQGARFAGVYVGSLSAPQVREVVDFADFVLVVGALTAEFCTFAFHFAYKPKNIGLVHARHARVGARGFPDAPLRALLGLLVQRWTPRASANAREPVPEPSALRVAPNPATPLRHEWLWARLSRWFAPGDILVSETGTSAFGVLQTRLPPGVCVVSQPLWGSVGYSVGACLGVLVATRAAAPPRRVVLFVGDGALQLTVQELSTMVRLRLAPLIFVLNNRGYSADRLLNRARHRANARYYDVQPWHNLALAPAFGASAYDPRAVTTVGELDALLSDPAFAQPSVLKMVEVALPSMDGPPALLDTLVPEHPEHADHKRPKLV

SEQ ID NO: 28386 - protein, 447 aa, Lyngbya majuscula
MKLPPGPQTPAILQMIEWVFHPSKLMQTCAQRYGDTFTVKVGPNLAPVVFLSDPKAIQKIFTADLKQFETGKLNKIAQPLIGEYSLMLQDGKYHQRQRRLLMPPFHGERMRRYNKIIDDIAKQVISQWPEGKPFSIRPSIGKISLELIVECVFGLRKGPRSQHLIQLLTLMAEYTSKPLAIALVSCKPMQRDFGSWSPWGSFIRLKQQITKLIYDEIGERRSQFDSSRTDILTLLMSARDEDGMPMTDVELHDQLITFLMGGHDTTTTALVWAFYWIHYLPEVREKLLRELDSLGDDLEESNIIKLRYLNAVCSETLRINPISVLTLFRSVKSPLQLMSYQYDPGTILAGCIYLTHRREDLYPEPEKFKPERFLERQFSFYEYLPFGGGNRRCVGDALAMFVMKRVIATVLREKQLTLVDRRPVKPVFRGPGLAPSGSMQMVAVTKK

SEQ ID NO: 28387 - protein, 726 aa, Escherichia coli
MSTSDDIHNTTATGKCPFHQGGHDQSAGAGTTTRDWWPNQLRVDLLNQHSNRSNPLGEDFDYRKEFSKLDYYGLKKDLKALLTESQPWWPADWGSYAGLFIRMAWHGAGTYRSIDGRGGAGRGQQRFAPLNSWPDNVSLDKARRLLWPIKQKYGQKISWADLFILAGNVALENSGFRTFGFGAGREDVWEPDLDVNWGDEKAWLTHRHPEALAKAPLGATEMGLIYVNPEGPDHSGEPLSAAAAIRATFGNMGMNDEETVALIAGGHTLGKTHGAGPTSNVGPDPEAAPIEEQGLGWASTYGSGVGADAITSGLEVVWTQTPTQWSNYFFENLFKYEWVQTRSPAGAIQFEAVDAPEIIPDPFDPSKKRKPTMLVTDLTLRFDPEFEKISRRFLNDPQAFNEAFARAWFKLTHRDMGPKSRYIGPEVPKEDLIWQDPLPQPIYNPTEQDIIDLKFAIADSGLSVSELVSVAWASASTFRGGDKRGGANGARLALMPQRDWDVNAAAVRALPVLEKIQKESGKASLADIIVLAGVVGVEKAASAAGLSIHVPFAPGRVDARQDQTDIEMFELLEPIADGFRNYRARLDVSTTESLLIDKAQQLTLTAPEMTALVGGMRVLGGNFDGSKNGVFTDRVGVLSNDFFVNLLDMRYEWKATDESKELFEGRDRETGEVKFTASRADLVFGSNSVLRAVAEVYASSDAHEKFVKDFVAAWVKVMNLDRFDLL

SEQ ID NO: 28388 - protein, 415 aa, Unknown
  Mycobacterium sp. MCS
MSVHAPAAPDLRTEVHDAARRARVASRTLATLSTETKNRALRAAADRVLMDAHLIIAGNERDLEKARAAGTPDAMLDRLALNPQRIDGVAAGLRQVASLPDPVGEVLRGNTLVNGLQLRQQRVPLGVVGIVYEGRPNVTVDAFGLTLKSGNAVLLRGSSSAAHSNAALVDSLRAALVAEGLDANAVQLLPSHDRASVTHLIQARGLVDVVIPRGGAGLIDAVVRDAQVPTIETGVGNCHVYVHSAADLDMAETILLNAKTRRPSVCNAAESVLIDAAIAEEAVPRLTKALQDAGVTVHADPTEEELRAEFLSMDIALAVVDGVDAAIAHVNEYGSGHTEAIVTADLAAAQRFTERVDAAAVMVNASTAFTDGEQFGFGAEIGISTQKLHARGPMGLPELTSTKWIVWGDGHTRPA

SEQ ID NO: 28389 - protein, 162 aa, Brassica rapa
MVAPFTGLKSSSAFPVTRKANNDITSIVSNGGRVSCMKVWPPVGKKKFETLSYLPDLTEVELGKEVDYLLRNKWIPCVEFELEHGFVYREHGSTPGYYDGRYWTMWKLPLFGCTDSAQVLKEVQECKTEYPNAFIRIIGFDNNRQVQCISFIAYKPPSFTGA

SEQ ID NO: 28390 - protein, 331 aa, Gluconobacter oxydans
MSKKVPLSPAPFEGYAAPRGHVFNSFLETVGGTPLVALPHLTQREHLNGRLLLKLEFFNPLGSVKDRIGVAMLRDAEARGLITPGRTVLIEPTSGNTGISLAFAAVALGYRLIVTMPENASTERRKMLRLMGADTELTPASRGMAGAIERAEQLNRTLPDAWMPSQFENDANPAVHEATTAREIWEDTAGKVDMVVAGLGTGGTASGIAHGLKKHRKSIKVYGVEPRESAVLHGDEPGPHGIQGIGPGFEPDTLDLKALDGVFEVSEQEAVATARLCAAVEGIPIGISSGAALFAGMELARKPSSRGKTIVAIVPSFAERYLSTQLFDGLA

SEQ ID NO: 28391 - protein, 711 aa, Unknown
  Sulfitobacter sp. EE-36
MFNVTKKSMQWGEETLTLETGKVARQADGSVIATLGETSVMANVTFARQQKPGQDFFPLTVHYQEKYYAAGKVPGGFFKREARPTEKETLTARLIDRPIRPLFVPGFKNEVLVMCTVLSHDLVNDPDMVAMIAASAALTISGAPFRGPIGACRVGFEDGDYVLNPTVDDMQDLRLNPDQRLDLVVAGTKEAVMMVESEAYELSEEEMLGAVKFAHEQIQPVIDLIIDLAEDAAKEPFDFQPVDYSDLSAAVKAAGEDAMRAAFAIADKQERTAAVAAARETIKAALTEEQLEDANLGSALKGLEASILRGDVVKTGKRIDGRKTDEIRDIVAETGILPRTHGSSLFTRGETQGLVVTTLGTGDDEQFIDALHGNFKSNFMLHYNFPPYSVGEVGRVGGPGRREIGHGKLAWRALQAVLPASTDFPYTIRVVSEITESNGSSSMASVCGGSLSMMDAGVPLKAPVAGVAMGLILEDDGSYAILSDILGDEDHLGDMDFKVAGTEAGITSLQMDIKIAGITPEIMEKALAQAKAGRVHILGEMNKAISGAGEFSVHAPRIETMQIPTDKIREVIGSGGKVIREIVEVSGAKVDINDEGIIKIASPNGDSIKKAYDMIWSIVAEPEEGAVYTGTVVKIVDFGAFVNFFGKRDGLVHVSQIENRRLNHPSDVLKEGQEVKVKLLGFDDRGKVRLSMKVVDQETGEEIKKEEGGEA

SEQ ID NO: 28392 - protein, 542 aa, Streptococcus pyogenes
MTIDKKKVVYQIYPKSYKDTTGNGVGDLRGIIDKLPYLQELGIDMIWLNPFYPSPQRDNGYDVSDYTAVNPDFGTMADFEDLVKAAKEHQIELMLDMVLNHCSTDHEWFQKALAGDPYYQDFFILRDQPTDWVSKFGGNAWAPFGDTGKYYLHLFDVTQADLNWRNPHVREELAKVVNFWRDKGVKGFRFDVINLIGKDEELVDCPVNDGKPAYTDRPITHTYLHDLNQASFGQDDSFMTVGEMSATTIDNCLLYTAPEREELSMAFNFHHLKVDYENGQKWTIMAFDFAALRDLFHAWGEGMGQGNGWNALFYNNHDQPRALNRFIDVTHFRNEGATMLAASIHLSRGTPYIYMGEEIGMLDPDFDSMDDYVDVESLNAYSSLLVSGKSAEEAFAIIKDKSRDNARTPMQWDASEHAGFTTGKPWLEVGKSYRDINVETEKEGRIFPFYQRLIALRKELPIIAEGDYRAAFKDSQAVYAFERHLGDQCLLVLNHFYADEVELELPPRYQHGQVLISNYEKVSICEKVILKPYQTLAILAEN

SEQ ID NO: 28393 - protein, 330 aa, Coprinopsis cinerea
MAPALTLEKPVETNAFPRKAASVETSENYEGNYKFAPIEEAQVSRAMIKRYFNTMYDRAISDVVIVGAGSAGLSCAYSLATQRPDLKITIVEAGVAPGGGAWLGGQLMTPMFSFIHKYREYEISPPSQVIRKPADAFLRELGVPYEDEGNFVVVKHAALFTSTLLSKVLAKPNVVMMNATAVEDLIVHEDFAGQQRVAGVVTNWTLVALNHDTQSCMDPNTITAPVIVSATGHDGPMGAFSAKRLVSTGLLKELGNMRGLDMNRAEPAIVNGTREVVPGLILTGMELSEHDGSNRMGPTFGAMIGSGHKAAHEAIRILDRHKVVNGKVVA

SEQ ID NO: 28394 - protein, 473 aa, Pseudomonas fluorescens
MPVGNHPPHGETAQGGPLKRELGERHIRLMALGACIGVGLFLGSAKAIEMAGPAIMLSYIIGGLAILVIMRALGEMAVHNPVAGSFSRYAQDYLGPLAGFLTGWNYWFLWLVTCVAEITAVAVYMGIWFPDVPRWIWALAALVSMGSINLIAVKAFGEFEFWFALIKIVTIIAMVLGGIGIIAFGFGNDGVALGISNLWAHGGFMPNGVTGVLMSLQMVMFAYLGVEMIGLTAGEAKNPQKTIPNAIGSVFWRILLFYVGALFVILSIYPWNEIGTQGSPFVMTFERLGIKTAAGIINFVVITAALSSCNGGIFSTGRMLYSLAQNGQAPAGFARTSSNGVPRRALLLSIFALLLGVLLNYLVPEKVFVWVTSIATFGAIWTWVMILLAQLKFRKGLSASERAGLKYKMWLFPVSSYLALAFLVLVVGLMAYFPDTRVALYVGPAFLVLLTVLFYVFKLQPKDSVQGAMRSAS

SEQ ID NO: 28395 - protein, 635 aa, Persea americana
MKGCDCIEPQWSSDDLLVKYQYLSDFFIAVAYFSIPLELVYFVQKSAFFPYRWVLTQFGAFIILCGATHFISLWTFTIHSKTVILVMAVAKVSTAVVSCATALMLVHIIPDLLSVKTREMFLKNKAEELDREMVIIRAQEETGRHVRMLTHEIRSTLNRDTILKTTLVELGRTLGLEECALWMPSHNGSSLQLSLTLRYPISVGATVSIQLPIVNKVFNSIHAVIIPHSCPLARIRPLSGKYVPPEVAAVRVPLLYLSNSQVNNWPELSANGYAVMVLMLPSDSARKWHVHELELVEVVADQVAVALSHASILEESMRAQDMLTEQNAALDLARQEAERAICARNDFLAVMNHEMRTPVHAIIALSSLLLETELTPEQRVMVETVLKSSNLLETLINDVLDLSRLEDGSLKLDIGIFNLHAVFREVINLIKPIAAMKKLSLSLMVAPNVPAFAVGDERRLMQIILNVAGNAVKFTKEGQVSVMACVEKQESLADPQALESYPASSDSHFHLRVQIKDSGCRVSPQDIPHLFTKFCICTRSGVNRSQDGSGLGLAICKRFVNLMEGHIWLQSEGLGKGCTATIVVKLGNNGNKTEESTQVVPRAHPKCGVENLSSRNPFLTISSRTQILKKCLLDF

SEQ ID NO: 28396 - protein, 558 aa, Geobacter sulfurreducens
MSIVVIGANAAGAKAASKAKRINPTAEITLIDRGTFISYGACGIPYFVSDTVEDVKELMSTPVGVVRDHQFFRKVKGVTVKTATEVIAIDRAAKTVCMRDCQTSRETKLPYDRLVLATGSTPFIPQISNVNLANVLTVKSIEDAELLKSLAVPGTRACIVGGGLIGLETAEALRHKGLQVAVVEMRDQMLPGVLDWEMAALVEKQLRQQGVTVMTGSAVTGLVGDAAVEAVQIGDVRIPADLVVLAPGVAPNVELARGAGLEIGPTGAIAVDTRQCTTDPDIYACGDCCETTHLITGKKVFIPLGSTANKQGRVAGINAAGGEATFAGVIGTSILRVFAVNAGKTGLTEAEAKAHGFEVETVLSPSHDKAHFFPGAKPIILKLVAERGTGRILGLQAVGEGAVDKRLDAAATAITFGATAEQVAQLDLAYAPPYSAAMDNLIVAADILKNKLAGHARGITPREVKRKFDEGDDFILLDVRSPAEHNAVGIEGAKLIPLGMLREKLEELPRDKEIIAFCKISLRGYEAQKILDAAGFRNAKFMDGGILAWPFALRTSDK

SEQ ID NO: 28397 - protein, 719 aa, Exiguobacterium sibiricum
MINNELETQQVRLYSVEFVTFQTILMETETPFGQGEFSLVCDGEPMDYSIENREDMDGTIKLTLLLDRAVELERCYEIILPDQERVRVLPNRIVQTAGFDRKYSYEGPLGAVYETDMISLYVWSPLAERLECIRYDQDGVERDSRDFERQERGAYRLVVPRSWENSLYRYRVTTYQGTEEVVDPYAKAVSVNGQFAVLLDVEQEINRQFPHRQKRPLLIKPTDAILYEAHIRDFTIDPSSGSHYPGQYLGMTETGTVSPEGRSTGIDYLLDLGVTHLQLLPVHLFTTTEEVSRLPYNWGYDPVQWFSLTGCYASDPIDPKVRILEYVGMIERLHAAGIRVTFDVVMNHVYIRERSALEYLVPGYYFRYEMDGTLANGTGVGNDTASERFMMRRMIVDCLTYFADIFHVDAFRFDLMGIHDVETMNHVRSALDHIDPTILVYGEGWDLATPLPQRQKAISSVASQMPRIGHFNDVFRDALKGSTFNETDCGFVSGNGWWEGEVHNGMAGSITLNGQTTGRFPEPTYSINYVEAHDNHTLYDKLTLARPDLDETTRLQMSRLAQTIIFLSAGIPFLHAGQEFGRTKQGVENSYNAPDAINRVDWTLRDRQAQMVEYLKNILQIRRMHGGFRLHRANQVQELMHFLPMQPGVIAYEVGAVHSYDAWQRTLVVHNVTSEKIDIVLDHPRWNVHVYGNEASITPIEKGVSQITVLPLSTTIATC

SEQ ID NO: 28398 - protein, 613 aa, Unknown
  Frankia sp. CcI3
METLDDGPVLGADLNQPLDAVFINAPLRDYGVRPRVNDFTLPVLGMAYIATYAAAQGFNVGVLDAEALGLGVKETYQLVNRLGPRWAGFNLLAPTYEVSAEIAAGLDRDIMVMIGGHQAKAMPAAIITDPRFGALEALVLGEGETRVAELLQDKRSRADLPGVMWLDPILRQPVTGGRPGAGHHLSPDVDRLPFVDRRFLVGDPYQAPDGRVEANMVGARGCPYDCSFCGAAVSANPDITIRTRTPAGIIAEMEVLHATGGVTAFRFVDDLFLGYERFIRQCMEAFTAARLGDRFVWDATGRINILHRVDNALLDVLAANGLREVALGVESGSERLLKYMGKRITPDMTRSVVRRLNERGISVKGYFILGFPTETREELAATVRHVRELWEVADGQPGNFRASVFEFRPYPGTPEWDRIVATGRYQPAQLLAYTAVDLTEGGLDEAMRGRDEFNFSVNIQFGEATVDEVRAALVELSREQPGMLRPQLRELDSQTAVLHQHIRQRLTTSNAANTRLDNRHAPQQTIPTSEPSPTETIRPHPVPPATANVDQLNGTSDYVRPTGTTWPGPGIGHSTPSRWAPMDEPTRNCSSSSRARSGTAGGCPNRNGPTGTS

SEQ ID NO: 28399 - protein, 269 aa, Yersinia pestis
MIVINRLWGRCYGTRGGITPTDTIEVLIMATVSMRDMLQAGVHFGHQTRYWNPKMKPFIFGARNKVHIINLEKTVPMFNEALAELTKISSRKGKILFVGTKRAASEAVKEAANNCDQFFVNHRWLGGMLTNWKTVRQSIKRLKDLEIQSQDGTFDKLTKKEALMRTRELNKLENSLGGIKDMGGLPDALFVVDADHEHIAIKEANNLGIPVFSIVDTNSDPDGVDFIIPGNDDAIRAVKLYLGAVATAVREGRSQDLAVQAEESFVEAE

SEQ ID NO: 28400 - protein, 210 aa, Unknown
  Acidovorax sp. JS42
MTSSALVPSSAELCPDRTAEVSRTTAETRITVRVNLDGTGAASLHTGIGFFDHMLDQIARHGLIDLQIDCDGDLHIDGHHTVEDVGITLGQAFARAVGDKKGIRRYGHAYVPLDEALSRVVVDFSGRPGLHLHIPFTAGSIGGFDTQLTYEFFQGFVNHAGVTLHIDNLKGINAHHQCETVFKAFARALRAALERDPRAAGVIPSTKGSL

SEQ ID NO: 28401 - protein, 547 aa, Geobacillus kaustophilus
MRKIVIVGGVAGGATAAARLRRLSEADHIVLFERGEYISFANCGLPYYIGGVIEERSKLLVQTAEVMSKRFCLDIRPLNEVTAIHRDRKTVSVRNVKTGEEYEETYDILILSPGAKPIVPPIPGIEEAEALFTLRTVPDTDRIKTYIDEQKPRRAVVIGGGFIGVEMAENLIHRGIHVTLIERANQVMAPIDYEMAAIVHGHMREHGVELLLEDGVRALEERGRRVVLTSGRVIETDMIILAIGVEPESWLAKEAGLELGVRGAIKVNEHLQTSDPSIYAIGDAVEVRHYIHGFETFVPLAWPANRQGRLVADHIHGFDVKYSGTLGTSIAKVFELAVAATGLNEKMLRALGVPYDVVHIHPLSHAGYYPNAEVMTFKLVFDRETGRIYGAQAVGKEGVDKRIDVIATAIKGGLTVRDLPDLELAYAPPFSSAKDPVNMAGYVASNIMDGLVETVQWHEIDRIVDDGGVLIDVRTEQETSRGMIRGSIPIPLDELRDRLHELPKEKPIYVTCQVGLRGYIAARILRQHGFRAINVDGGYRLYAVVKQ

SEQ ID NO: 28402 - protein, 551 aa, Lactobacillus johnsonii
MRHWYDQAIIYQIYPKSFQDSNNDGIGDLNGIRKRIPYLKELGINAVWLNPIFVSPQVDNGYDVSNYFAIDPKMGTMEDMDNLIKEMHEAGIHVIMDFVLNHTSDQHPWFQDAIKNPESIYRDYYIFAGENNQRPNNWGSFFGGSVWEKDPAGTGQFYFHLFDKRMPDLNWKNPEVRHAMTEIAKYWLEKGIDGLRLDAFIHIAKADLRQNFPVNSKDEEPVIAEPFFANLPQVQKWMRLFCEEIKQDYPDALLLGEAASANVNLAVDYTNKNNHLMDSVITFRYFTEDQSKIDPSFLSNYQPKPLDWVKFKQNQTIWQQTLSGISKPTLYWNNHDMARLATRIAKNDIQARSLAMLMYLQCGIPIIYYGEELGMKNLQFEDINDFKDDTVKEFVTSAEKAGKTSKEALLMASKTHKLPARGPMPWDNERNNGFTEKEPWIKGRKLDKVNVADEIADDSSMFNFYKKLISLKKEQLFQEGNYYLWPTSNGSYVYERNLKDKKALIAVSLSQEPIELEVGKEFSNERLSAGQYDLVAGKLRLEPYAGVVLEN

SEQ ID NO: 28403 - protein, 372 aa, Unknown
  Burkholderia sp. 383
MRSIIADSKRLVVKVGSSLVTNDGKGLDHAAIGRWAAQIAALRAQGKEVVLVSSGAIAEGMQRLGWSKRPREIDELQAAAAVGQMGLAQVYESRFTEHDIRTAQILLTHADLADRERYLNARSTMLTLLRLGVVPIINENDTVVTDEIKFGDNDTLGALVANLIEGDALIILTDQSGLFTADPRKDPNATLVAEANAGAPELEAMAGGAGSSLGRGGMLTKILAAKRAAHSGANTVIASGRETDVLVRLAAGEAIGTQLIARTARMAARKQWMADHLQVRGHVVIDAGAVEKLTAGGKSLLPIGVIDVQGAFARGEVIACVGPDGREVARGLTNYSSAETKLIHRKPSGEIESVLGYMLEPELIHRDNLVLV

SEQ ID NO: 28404 - protein, 511 aa, Salmonella enterica
MSLSKDNIWKLLAPLVVMGVMLLIPVPDGMPPQAWHYFAVFVAMIVGMILEPIPATAISFIAVTICVIGSNYLLFDASELADPAFKASKQALKWGLAGFSSTTVWLVFGAFIFALGYEVTGLGRRIALFLVKFMGKRTLTLGYAIVIIDILLAPFTPSNTARTGGTVFPVIKNLPPLFKSFPNDPSARRIGGYLMWMMVISTSLSSSMFVTGAAPNVLGLEFVSKIAGVQISWLQWFLSFLPVGIILLIVAPWLSYVLYKPEVTHSAEVAAWAGGELKNMGRLSRKEWTLIGLVLLSLGLWVFGGKIINATAVGLLAVSLMLALHVVPWKDITRYNSAWNTLVNLATLVVMANGLTRSGFIDWFANTMSTHLEGFSPDATVIVLVLVLVLVLVLVLVLVLVLVLVLVLVLVFYFAHYLFASLSAHTATMLPVILAVGKGIPGVPMEQLCILLVLSIGIMGCLTPYATGPGVIIYGCGYVKSRDYWRLGAIFGVIYIAMLLLVGWPILAMWN

SEQ ID NO: 28405 - protein, 267 aa, Oryza sativa
MASSVAAAASTFLGTRLADPAPQSGRIVARFGFGGGKKAAAKKAARPSAPTTDRPLWFPGAPAEYLQFELDSLDQNLAKNNAGEIIGTRFETGEVKSTPFQPYTEVFGLQRFRECELIHGRWAMLATLGALSVEWLTGVTWQDAGKVELVDGSSYLGQPLPFSISTLIWIEVLVIGYIEFQRNAELDPEKRLYPGGSYFDPLGLASDPEKKERLQLAEIKHARLAMVAFLGFAVQAAATGKGPLNNWATHLSDPLHTTIFDTFSSSS

SEQ ID NO: 28406 - protein, 341 aa, Xanthomonas campestris
MSDPTQKIAVLGAGSWGTALAALVARHGHPTVLWGRDAAMVDAIDRTHENPRYLPGIALPDSLRATTDLQQTIAGASWILVVVPSHAFTETIKLLAPLRPAGAGIAWATKGFEPGSGRFLHEVARDILGPSVPLAVVTGPSFAKEVTLGLPTAITVHGDDAAFAQVVADAMHGPTFRAYTGDDMVGAELGGAMKNVLAVATGVADGMQLGLNARAGLITRGLNEMLRLAAVIGARPETLMGLAGLGDLVLTCTGDLSRNRRLGLALGRGQSLSDAIREIGQVVESVQTADEVMRQAEQHGIELPISNAVRAVLHGEITPEAGLKELLARERKPEYPQTLFT

SEQ ID NO: 28407 - protein, 858 aa, Brassica napus
MKGVRKTYDSSYTLSFLLVFFVMFLFHPALSIHINTLSSTESLTISNNRTLVSPGNVFELGFFRTTSSSRWYLGIWYKNLPYKTYVWVANRDNPLSDSIGTLKISNMNLVLLDHSNKSVWSTNLTRGNERSPVVAELLENGNFVIRYSNNNNASGFLWQSFDFPTDTLLPEMKLGYDRKKGLNRFLTAWRNSDDPSSGEISYQLDTQRGMPEFYLLKNGVRGYRSGPWNGVRFNGIPEDQKLSYMVYNFTDNSEEAAYTFRMTDKSIYSRLIISNDEYLARLTFTPTSWEWNLFWTSPEEPECDVYKTCGSYAYCDVNTSPVCNCIQGFKPFNMQQWELRVWAGGCIRRTRLSCNGDGFTRMKNMKLPETTMAIVDRSIGRKECKKRCLSDCNCTAFANADIRNGGSGCVIWTGELEDIRNYFDDGQDLYVRLAAADLVKKRNANGKTIALIVGVCVLLLMIMFCLWKRKQKRAKTTATSIVNRQRNQDLLMNGMILSSKRQLPIENKTEELELPLIELEAVVKATENFSNCNKLGQGGFGIVYKGRLLDGQEIAVKRLSKTSVQGTGEFMNEVRLIARLQHINLVRILGCCIEADEKMLVYEYLENLSLDSYLFGNKRSSTLNWKDRFNITNGVARGLLYLHQDSRFRIIHRDMKVSNILLDKNMTPKISDFGMARIFARDETEANTRKVVGTYGYMSPEYAMDGVFSEKSDVFSFGVIVLEIVSGKRNRGFYNLNHENNLLSYVWSHWTEGRALEIVDPVIVDSLSSLPATFQPKEVLKCIQIGLLCVQERAEHRPTMSSVVWMLGSEATEIPQPTPPGYSLGRSPYENNPSSSRHCDDDESWTVNQYTCSDIDAR

SEQ ID NO: 28408 - protein, 241 aa, Yersinia pestis
MATVSMRDMLQAGVHFGHQTRYWNPKMKPFIFGARNKVHIINLEKTVPMFNEALAELTKISSRKGKILFVGTKRAASEAVKEAANNCDQFFVNHRWLGGMLTNWKTVRQSIKRLKDLEIQSQDGTFDKLTKKEALMRTRELNKLENSLGGIKDMGGLPDALFVVDADHEHIAIKEANNLGIPVFSIVDTNSDPDGVDFIIPGNDDAIRAVKLYLGAVATAVREGRSQDLAVQAEESFVEAE

SEQ ID NO: 28409 - protein, 316 aa, Fusobacterium nucleatum
MRIKFDRRIFMLANSVIDLIGNTPLVKINNIDTFGNEIYVKLEGSNPGRSTKDRIALKMIEEAEKEGLIDKDTVIIEATSGNTGIGLAMICAVKNYKLKIVMPDTMSIERIQLMRAYGTEVILTDGSLGMKACLEKLEELKKNEKKYFVPNQFTNVNNPKAHYETTAEEILKDLNNKVDVFICGTGTGGSFSGTAKKLKEKLPNIKTFPVEPASSPLLSKGYIGPHKIQGMGMSIGGIPAVYDGSLADDILVCEDDDAFEMMRELSFKEGILGGISTGATFKAALDYSKENADKGLKIVVLSTDSGEKYLSNICDL

SEQ ID NO: 28410 - protein, 485 aa, Wolinella succinogenes
SNINEREKERVALNKTAHSQGIEGKAMSEEWARYYPRQFDSWKKTKESDNITDMLKEKPALVVAWAGYPFSKDYNAPRGHYYALQDNINTLRTGAPVDGKTGPLPSACWTCKSPDVPRIIEQDGELEYFTGKWAKYGDEIVNTIGCYNCHDDKSAELKSKVPYLDRGLSAAGFKTFAESTHQEKRSLVCAQCHVEYYFKKTEWKDDKGVDKTAMVVTLPWSKGISTEQMEAYYDEINFADWTHGISKTPMLKAQHPDWELYKTGIHGQKGVSCADCHMPYTQEGAVKYSDHKVGNPLDNMDKSCMNCHRESEQKLKDIVKQKFERKEFLQDIAFDNIGKAHLETGKAMELGATDAELKEIRTHIRHAQWRADMAIAGHGSFFHAPEEVLRLLASGNEEAQKARIKLVKVLAKYGAIDYVAPDFETKEKAQKLAKVDMEAFIAEKLKFKQTLEQEWKKQAIAKGRLNPESLKGVDEKSSYYDKTKK

SEQ ID NO: 28411 - protein, 511 aa, Glycine max
MAQPSTRIGLAGLAVMGQNLALNIAEKGFPISVYNRTTSKVDETVERAKQEGNLPVYGYHDPEAFVHSIQKPRVIIMLVKAGAPVDQTIKTLSAYMEKGDCIIDGGNEWYENTERREKEVAELGLLYLGLGVSGGEEGARNGPSLMPGGSFEAFKYIEDILLKVAAQVPDSGPCVTYIGKGGSGNFVKMIHNGIEYGDMQLIAEAYDVLKSVGKLSNEELQSVFSEWNKGELLSFLIEITADIFGIKDDKGDGYLVDKVLDKTGMKGTGKWTVQQAAELSIAAPTIEASLDARFLSGLKEERVEAAKVFKSGGIGDIVTDQHVDKQKLIDDVRKALYAAKICSYAQGMNLIRAKSIEKGWDLKLGELARIWKGGCIIRAIFLDRIKQAYERNPNLANLLVDPEFAKEIIDYQSAWRRVVCLAINSGISTPGMSASLAYFDTYRRERLPANLVQAQRDYFGAHTYERVDIEGSYHTEWFKLAKQSKKLDYCISANQDFPNKCNIFCSDCMLS

SEQ ID NO: 28412 - protein, 141 aa, Triticum aestivum
MTGNHGGRRRKAPQQGRPARDDAVDISQSNSDGQDGAEGSQPKRRLQRLTPQQTQVLEGFFGICAHPDENQRMGMSESTGLTMQQVKFWFQNKRTHMKHVTGKEETYRMKAQNEMLREENKRLASAANTSFCPSCVALPGL

SEQ ID NO: 28413 - protein, 219 aa, Oryza sativa
MVEPSAAAAFPPAPQVAPAYPVNPMQLPEHQQHAIQQVQQLQQQQKEQLQAFWADQMAEVEQMTEFKLPNLPLARIKKIMKADEDVKMIAGEAPALFAKACEMFILDMTLRSWQHTEEGRRRTLQRSDVEAVIKKTDIFDFLVDIITDDKMKDDGMGSQAASMVSPYTSGGMGFSFDLYPNQHHLAYMWPPQEQQEQWPPQEQQEQKQKQDSDGGGQDE

SEQ ID NO: 28414 - protein, 561 aa, Xanthomonas oryzae
MTESFAELFEASQANLAKLKPGSIVTGTVVEVRGDVVVINAGLKSEGIVPIEQFRNDAGEIDVGVGDQVKVALDSIENGFGETVLSREKAKRAMVWDELEDALENNETITGRISGKVKGGFTVDIKDVRAFLPGSLVDVRPVRDPAYLEGKELEFKLIKLDRKRNNVVVSRRAVVESEHSEEREQLMDKLQEGAILKGVVKNLTDYGAFVDLGGIDGLLHITDMAWKRVRHPSEVVNVGDELDVRVLKFDRERNRVSLGLKQLGEDPWDNIARRYPANSRVFGKVSNVTDYGAFVEIEPGVEGLVHVSEMDWTNKNVNPSKVVQVGDEVEVMVLDVDEERRRISLGMKQVAANPWETFAATHKKNDKVSGQIKSITDFGIFIGLDGGIDGLVHLSDISWNTTGEDVVRNYKKGDTLEAVVLAVDPERERISLGVKQLEQDPFGQYMASNPKGSKVEGVVREVDAKGATIDLADGIEGYVASRDIANERVDDATQHLKVGDKIEAKFVGMDRKGRTLQLSIKAKDDAEMRETLEDYQSASASGGMTQLGALLRAQLNSNKSE

SEQ ID NO: 28415 - protein, 991 aa, Unknown
  Mycobacterium sp. MCS
MADSENTQAQDSPDSSEEASPRERLPERLRVHSLARVLGTTSRRVLDALAELDGRARSAHSTVDKTEAERVREVLAGSDGDAPVEAPAPAEIAESVADAPEVVIETVESVEVTIDVAPVGDTSDVPEPEDEPESRTILETAPVERADYLPLFVAPQPVRFEPADEDDDEDEDDDVAASADSEDDDEDDQSERPAARRRRRGRRGRGRGRGEQSDDNGEPDAAEGTETKTDGQADSDQDTGDDSDEDGDEDTSGGDGSSRRRRRRRRRKSGASDDSDNGSPDDPPNTVVHERPPRERGGKSGDSDDNEIQGISGSTRLEAKRQRRRDGRDAGRRRPPILSEAEFLARREAVERVMVVRDKVRTEPPHEGARYTQIAVLEDGVVVEHFVTSPASASLVGNIYLGIVQNVLPSMEAAFVDIGRGRNGVLYAGEVNWEAAGLGGQNRKIEQALKPGDYVVVQVSKDPVGHKGARLTTQVSLAGRYLVYVPGASSTGISRKLPDTERQRLKEILREVVPADAGVIIRTASEGVKEDDIRSDVNRLQERWTQIEAKAAEITAKKAGAAVALYEEPDVLVKVIRDLFNEDFSGLIVSGDEAWNTINSYVESVAPDLMPRLTKYEPAGNPNGEGPDVFAVHRIDEQLAKAMDRKVWLPSGGTLVIDRTEAMTVVDVNTGKFTGSGGNLEQTVTRNNLEAAEEIVRQLRLRDIGGIIVIDFIDMVLESNRDLVLRRLTEALARDRTRHQVSEVTSLGLVQLTRKRLGTGLIEAFSTPCPHCAGRGIVLHGDPIDNASGNGRKSEPGTGRRSKRGKKGGKPEEAPAAVPVIKVPPHPAGEHPMFKAMAAANGRDDESEDESDESADEQSGAREDDTAEKVHEAVGEELDDEDFEDAEDAEDSDDSDEDEDEDEDEDSDDSDEDEIDLDNDDDEEDDDIEVLDDEDSDEDEDSDEDEDSDEDSDEDSDEDSDDEDEPEVIAVPVRRPRRRAAARPAGPPSSE

SEQ ID NO: 28416 - protein, 175 aa, Oryza sativa
MAPSVMASSATTVAPFQGLKSTAGMPVARRSGNSSFGNVSNGGRIRCMQVWPIEGIKKFETLSYLPPLTVEDLLKQIEYLLRSKWVPCLEFSKVGFVYRENHKSPGYYDGRYWTMWKLPMFGCTDATQVLKELEEAKKAYPDAFVRIIGFDNVRQVQLISFIAYKPPGCEESGGN

SEQ ID NO: 28417 - protein, 372 aa, Cicer arietinum
MHSLYARTHKFSLASPLFLLGLFTINLIPTADAQIGICYGMMGNNLPPANEVIDLYKANNIKRMRLYDPNQAALQALRNSGIELILGVPNSDLQSLATNNDIAIQWVQKNVLNFYPSVKIKYIAVGNEVSPIGGSSWLAQYVLPATQNIYQAIRAKNLHDQIKVSTSIDMTLIGNSFPPSKGSFRSDVRSYLDPFIGYLVYAGAPLLVNVYPYFSYVGNPRDISLPYALFTSPNVMVQDGQYGYQNLFDAMLDSVHAALDNTGIGWVNVVVSESGWPSDGGSATSYDNARIYLDNLIRHVGKGTPRRPWATETYIFAMFDENQKSPELEKHFGVFNPNKQKKYPFGFGGERRNGEIVNDDFNATTVSLKSDM

SEQ ID NO: 28418 - protein, 284 aa, Nocardia farcinica
MQLEHGAQKRDRREPAVEIAVVQFTPGVEPAANLATLREHVEEAARHGARVVIAPEYAMYAVRKLDERVVAVAQPLDGPFATGLADLARNAGVYLVAGMVETGQPGEERIRNTLVVTGPAGERIAIYRKVHLYDAFGHRESDVIEAGPIIEPALFTVDGVTIGLQTCFDLRFPEGFRRIAAAGAHVLAVPAQWIPGPAKVDQWTTLLRARAIENTVYVAAADQAAPLGSGASMIVDPAGAVLAELGDAPGVLTATVDLEHLAAVRTRNPSLALRRFAVTARAAE

SEQ ID NO: 28419 - protein, 992 aa, Unknown
  Sulfitobacter sp. EE-36
MLRKKTNGMARRPQRAGMLSDIAEKSVDRRAFLRGSGLAIGGLAAIASTAGSVTQASAATAVSGAVETIKSVCTHCSVGCTVIAEVSNGVWTGQEPGWDSPFNLGSHCAKGASVREHAHGERRLKYPMKKEGGQWVRISWEQAINEIGDKMNVIREESGPDSVYWLGSAKHNNEQAYLFRKFAAYWGTNNVDHQARICHSTTVAGVANTWGYGAMTNSYNDIHNSQAIFVIGGNPAEAHPVSLLHLLKAKEQNNAPMIVCDPRFTRTAAHADEYVRFRPGSDVALVWGILWHIFENGWEDKEFIRTRVWGMDQIRDEVAKWTPEEVERVTGAPASQLERVARTLANNRPGTVIWCMGGTQHSNGNNNTRAYCILQLALGNMGTAGGGTNIFRGHDNVQGATDLGVLADTLPGYYGLSAGAWAHWARVWEEDLEWLQSRFSKASFNDTSMMNLTGIPVSRWIDGVLEDKENIDQPDNTRAMVLWGHAPNSQTRQKEMVTAMEKLDLMVVVDPYPTVSAVMQDRQDGLYLLPATTQFETRGSVTASNRSLQWRDQVVEPLFESKPDHTIIKLFADKFGFSDRLFKNIALDGDEPNIEDLTREFNRGMWTIGYTAQSPERMKMHMANQHTFDRTTLRAKGGPADGDFYGLPWPAWGTPEMNHPGTANLYDMSLPVAEGGLTFRARFGVERDGDNLLAEGVYSAGSEIKDGYPEFTMAMLRELGWDKDLTDEEMAVINYVAGYPEGQPANAKPDEEVGETSQTGETPSDYIADTGGVNWKTDLSGGIQRVAIKHGCAPFGNAKARAVVWTFPDPVPIHREPLYTNRRDLVADYPTYDDKKFWRLPTMYKSIQENDFSKDYPIVLTSGRLVEYEGGGDETRSNPWLAELQQDMFIEINTRDANNLGVRDGADVWVEGPEGGKVKVMAMVTERVESGVAFMPFHFGGHMEGVDLRDRYPEGADPYVLGESTNTAQTYGYDSVTQMQETKATLCKIWTA

SEQ ID NO: 28420 - protein, 159 aa, Clostridium perfringens
MEIYDISVKDINGENVSLEIYRGKVLLIVNTASKCGFTKQFDGLEELYEKYKDEGFEVLGFPCNQFKEQDPGSNSEIMNFCKLNFGVTFPMFEKIDVNGENESLLYSYLKEQKSGMFGSKIKWNFTKFLVDREGNVIKRFSPQTTPKSIEKDIEELLAK

SEQ ID NO: 28421 - protein, 467 aa, Exiguobacterium sibiricum
MQLKREMTSRHLFMISLGGIIGTGLFLGSGLTISQAGPLGAVLSYIVGGTIMYLTMLCLGEMAVHMPVSGSFQTYTTRFIGPGIGFAVGWIYWLGWAVTVALEITAAGSLMDRWFPNTPIVIWCAIFTVILFGLNAVSAKAFGEAEFWFSSLKVLAILFFIALGGAAWFGWIDMTAARPESLFANFTSNGLFPNGALGVLTTMIAVNFAFQGTELIGVAAGESNDPEKSIPKAIRNTVWRTFIFFVLSITIVGALIPYETAGGISSPFIMVFDAIGIPYAADLMNIVVLTALLSVGNSGLYAATRMLWSMSQEGMISKKLAIVNSRGVPMRALCFTMLFAMLSLLTAFFAEDTVFIWLLSLAGLGAQVGWISISASQIAFRRQFIKNGHTVSELKFKTPFFPVLPIISFSLNMLVLISLAFQADQRIALYIGVPFFLLTWGCYHLFVKGKHIAAQTERQAASSTLES

SEQ ID NO: 28422 - protein, 582 aa, Glycine max
MCGILAVLGCSDDSRAKRVRVLELSRRLKHRGPDWSGLHQHGDCFLAHQRLAIVDPASGDQPLFNEDKSVIVTVNGEIYNHEELRKQLPNHKFRTGCDCDVIAHLYEEHGEDFVDMLDGIFSFVLLDTRDNSFIVARDAIGVTSLYIGWGLDGSVWISSEMKGLNDDCEHFECFPPGHLYSSKERGFRRWYNPPWFSEATPSTPYDPLVLRHTFEQAVIKRLMTDVPFGVLLSGGLDSSLVASVTSRYLANTKAAEQWGSKLHSFCVGLEGSPDLKAAKEVADYLGTVHHEFTFTVQDGIDAIEDVIYHVETYDVTTIRASTPMFLMSRKIKSLGVKWVISGEGSDEIFGGYLYFHKAPNKEEFHRETCRKIKALHQYDCLRANKSTFAWGLEARVPFLDKAFINTAMSIDPESKMIKRDEGRIEKWILRRAFDDEEHPYLPKHILYRQKEQFSDGVGYSWIDGLKAHAAKHVTDKMMLNAGNIYPHNTPTTKEAYYYRMIFERFFPQNSARLTVPGGASVACSTAKAVEWDAAWSNNLDPSGRAALGVHISAYENQNNNKGVEIEKIIPMDAAPLGVAIQG

SEQ ID NO: 28423 - protein, 251 aa, Unknown
  Malus x domestica
MGRQPCCDKLGVKKGPWTAEEDKKLVNFLLTHGQCCWRAVPKLAGLRRCGKSCRLRWINYLRPDLKRGLLNDAEEQLVIDLHARLGNRWSKIAARLPGRTDNEIKNHWNTHIKKKLVKMGIDPITHEPLHKQVTTPQEMPCEASNQPANSDMSIQQMNTNIPEHGISTNSDGNSTSENSPSNDSEPAEPNPNYSEEEDPLVSFILSDTFLEDLTWDFSTSSEYSSADNPTEENSLAWFMDCNDFGVEDFEL

SEQ ID NO: 28424 - protein, 266 aa, Petunia sp.
MAAATMAISSSSFAGKAVNVPSSSQITGNGKATMRKTVTKAKPVSSGSPWYGPDRVKYLGPFSGEAPSYLTGEFPGDYGWDTAGLSADPETFAKNRELEVIHCRWAMLGALGCVFPELFARNGVKFGEAVWFKAGSQIFSEGGLDYLGNPSLVHAQSILAIWACQVVLMGAVEGYRVAGGPLGEVIDPLYPGGSFDPLGLADDPEAFAELKVKEIKNGRLAMFSMFGFFVQAIVTGKGPLENLADHLADPVNNNAWAFATNFVPGK

SEQ ID NO: 28425 - protein, 183 aa, Unknown
  Burkholderia sp. 383
MNREEALHIFNHSEEIVSADAVNASISRMADAIRAEIGDAFPLVLSVMGGAAVFTGMLLPHLDFPLEFDYIHLTRYRNTTQGSPEMHWRVAPRESVKDRIVLVLDDILDEGETMAAIRDRILDMGAQRFMSAVLCEKTLSKAKPLHPDFCGFPVPDRYVFGCGMDAKGYWRNLPTIRALTTNV

SEQ ID NO: 28426 - protein, 134 aa, Bacteroides thetaiotaomicron
MSQYIYELEMKVRDYECDLQGIVNNANYQHYLEHTRHEFLTSVGVSFAALHEQGVDPVVARINMAFKTPLKSGDEFVSKLYMKKEGIKYVFYQDIFRKSDQKVVVKSTVETVCVVNGRLSNSELFDNVFAPYLK

SEQ ID NO: 28427 - protein, 205 aa, Thermoanaerobacter tengcongensis
MASMTGGQQMGRGSSTSLYKKAGLMPSPMEDIEEILITEEQLKAKVKELGEMITRDYEGKDLVLIGVLKGAIMFMSGLSRAIDLPLSIDFLAVSSYGSSTKSSGIVKIIKDHDIDIEGKDVLIVEDIIDSGLTLAYLRETLLGRKPRSLKICTILDKPERREADVKVDYCGFKIPDKFVVGYGLDYAEKYRNLPFIGVLKPELYK

SEQ ID NO: 28428 - protein, 392 aa, Robiginitalea biformata
MGALLGADIVYGDRLPEGLELLGLQDPDPFSLFDKDPEMVVRNSRPWNLEARAHLLDDAVTPNKYMFIRNNGLIPERPDPAAWTLTLDGEAVRGKKSYTLADLKNNFRKYTYRLTLECGGNGRSEFNPPASGNQWEVGAVSCAEWGGVRLRDVLEDAGYTDRAVYVGYHAADTHLSGDPGKEPISRGVPMEKALQDETLLAYEMNGGDIPLAHGYPLRLVAGGWPASASGKWIERLSVRDRVHDGAKMTGDSYRVPCRPVAPGTPVPDSDMCIIESMPVKSLITYPKTGATLARGRSLPFRGHAWAGELEVARVRYSIDFGSTWQDCRLEAPANRLAWQRFSGEAEFPREGYYELWAQAEDSQGRAQPMVLPGWNPKGYLNNACHRIAVKIT

SEQ ID NO: 28429 - protein, 266 aa, Nicotiana plumbaginifolia
MAASTTALSSPFAGKAVKLSPSSSEVTGNGKVTMRKTANKAKPVSSGSPWYGPDRVKYLGPFSGESPSYLTGEFPGDYGWDTAGLSADPETFAKNRELEVIHCRWAMLGALGCVFPELLARNGVKFGEAVWFKAGSQIFSEGGLDYLGNPSLVHAQSILAIWACQVVLMGAVEGYRVAGEPLGEVVDPLYPGGSFDPLGLAEDPEAFAELKVKEIKNGRLAMFSMFGFFVQALVTGKGPLENLADHLADPVNNNAWSYATNFVPGK

SEQ ID NO: 28430 - protein, 405 aa, Oryza sativa
  misc_feature (367)..(367): Xaa can be any naturally occurring amino acid
MAAATTSRRGPGAMDDENLTFETSPGVEVISSFDQMGIREDLLRGIYAYGFEKPSAIQQRAVLPIISGRDVIAQAQSGTGKTSMISLSVCQIVDTAVREVQALILSPTRELAAQTERVMLAIGDYINIQVHACIGGKSIGEDIRKLEHGVHVVSGTPGRVCDMIKRRTLRTRAIKLLILDEADEMLGRGFKDQIYDVYRYLPPELQVCLISATLPHEILEMTSKFMTDPVRILVKRDELTLEGIKQFFVAVEKEEWKFDTLCDLYDTLTITQAVIFCNTKRKVDWLTERMRSNNFTVSAMHGDMPQKERDAIMGEFRSGATRVLITTDVWARGLDVQQVSLVINYDLPNNRELYIHRIGRSGRFGRXKGVAINFVKKEDIRILRDIEQYYSTQIDEMPMNVADLI

SEQ ID NO: 28431 - protein, 467 aa, Shewanella oneidensis
MMKKMTGKTFALSALVAASFMAAGAMASDKTEPRNEVYKDKFKNQYNSWHDTAKSEELVDALEQDPNMVILWAGYAFAKDYKAPRGHMYAVTDVRNTLRTGAPKNAEDGPLPMACWSCKSPDVPRLIEEQGEDGYFKGKWAKGGPEVTNTIGCSDCHEKGSPKLRISRPYVDRALDAIGTPFSKASKQDKESMVCAQCHVEYYFEKKEDKKGFVKFPWDMGVTVDQMEVYYDGIEFSDWTHALSKTPMLKAQHPEYETWKMGIHGKNNVSCVDCHMPKVTSPEGKKFTDHKVGNPFDRFEETCATCHSQTKEFLVGVTNERKAKVKEMKLKAEEQLVKAHFEAAKAWELGATEAEMKPILTDIRHAQWRWDLAIASHGVAAHAPEEALRVLGTSVNKAADARVKLAQLLAKKGLTDPVAIPDISTKAKAQAVLGMDMEKMNAEKEAFKKDMLPKWDAEAKKREATYK

SEQ ID NO: 28432 - protein, 267 aa, Petunia sp.
MAAATMALSSPSFAGKAVKFSPSSSEITGNGKATMRKTVTKAKPVSSGSPWYGPDRVKYLGPFSGEAPSYLTGEFPGDYGWDTAELSADPETFAKNRELEVIHCRWAMLGALGCVFPELLARNGVKFGEAVWFKAGSQIFSEGGLDYLGNPSLVHAQSILAIWACQVVLMGAVEGYRVAGGPLGEVVDPLYPGGSFDPLGLADDPEAFAELKVKEIKNGRLAMFSMFGFFVQAIVTGKGPLENLADHLADPVNNNAWSYATNFVPGK

SEQ ID NO: 28433 - protein, 594 aa, Unknown
  Frankia sp. CcI3
MCGLSGELRFDGRGANVDAVVRMTATMVPRGPDGVGVWSAGPVAFGHRRLKIIDLSECGAQPMVDNELGLTTVFNGCIYNYQELRDELIAAGYRFFSTSDTEVIGKAYHRWGRRCVDHFAGMFAFAIAERDSGRLILARDRLGIKPLYLTGNSERLRFASTLPALLAGGGVSSDIDLVAFHHYLSFHSVVPAPHTILAGVRKLPAATVRVVEPDGTSTDDLYWRPSFTRDPAHADWTARDWQDAIAERLRLAVRRRMVADVPVGVLLSGGLDSSLIVALLAEAGQKDLATFSVGFEAVGGEPGDEFVYSDVIARYFDTDHHQIRVPGTRLLPAVDAAVAAMSEPMVSHDCVAFYLLSQEVSRHVKVVQSGQGADEVFAGYSWYPPLAGVGRTDAVDAYLRVFADRPHRDLPAMVEPHHLIEADASRHFVASHFARPGAETAVDAALRIDSTIMLVDDPVKRVDNMTMAAGLEARTPFLDHELVELAAACPPELKLASGGKGVLKNIGRPLMPVDVIDRPKGYFPVPAIRHLDGPFLDRVREALTDPAAKARGLFRPVWVQTMLAAPNDNRTALGANALWQAALLEMWLQTHTVA

SEQ ID NO: 28434 - protein, 128 aa, Glycine max
KVICHFYHREFSRCKIMDKHLKTLAPVYLGTKFIKLDAENAPFFVTKLGIKTLPCVILFKKGIAVDRLVGFQDLGSKDDFSTRALENILKMKGIIDEKKKDEDDEDDETDMSMNRRIRSSTAQDSDSE

SEQ ID NO: 28435 - protein, 469 aa, Pseudomonas aeruginosa
MDGQHLHQGELKRGLKNRHIQLIALGGAIGTGLFLGSAGVIKTAGPSMILGYAIGGFIAFLIMRQLGEMIVEEPVAGSFSHFAHKYWGGFAGFLSGWNYWVLYILVGMSELTAVGKYIQYWWPDVPTWATAAAFFVLINAINLANVKAFGETEFWFAIIKVAAIIGMILLGIYLLVGGGGGPQASVSNLWDRGGFFPNGLSGLVMTLAIIMFSFGGLELVGITAAEASEPRKVIPKAINQVIYRILIFYIGALAVLLSLYPWDQLVETINASGDDYSGSPFVQIFSLIGSGTAANILNFVVLTAALSVYNSGVYCNSRMLYGLAAQGDAPKVLMSVDRRGVPVLSILVSALITFLCVIVNYVLPHKALELLMSLVVAALVINWAMISLSHLKFRAAMKRQGVDTFFKALWSPFSNYLCLAFVVFILGIMLMIPGINISVYAIPFWLLLMWLCYRVKLSLAERRGLGQQA

SEQ ID NO: 28436 - protein, 564 aa, Lachancea kluyveri
MSEITLGRYLFERLNQVEVQTIFGLPGDFNLSLLDKIYEVPGMRWAGNANELNAAYAADGYARIKGMSCIITTFGVGELSALNGIAGSYAEHVGVLHVVGVPSVSSQAKQLLLHHTLGNGDFTVFHRMSANISETTAWVTDIATAPAEIDRCIRTTYVTQRPVYLGLPANLVDLMVPASLLDTPIDLSLKPNDPEAEAEVVNTVLELIKDAKNPVILADACASRHNVKSETKQLIDITQFPAFVTPLGKGSIDEQHPRFGGVYVGTLSNDDVKEAVESADLILSVGALLSDFNTGSFSYSYKTKNIVEFHSDYIKIRNATFPGVQMKFALQKLLSQVGEVVKDYKPVAVPAKPTPNPACDPSTPLKQEWVWNQVGRFLQEGDVVITETGTSAFGINQTHFPNNTYGISQVLWGSIGFTTGACLGAACAAEELDKNKRVILFIGDGSLQLTVQEISTMIRWGLKPYLFVLNNDGYTIERLIHGENAQYNEIQPWKNLDLLPTFGAKDYETYRVATTGEWDKLAQDEAFNKNSRIRMVEVMLPVMDAPSNLVKQAQLTASINAKQE

SEQ ID NO: 28437 - protein, 355 aa, Burkholderia mallei
MTSSDQTNSGADPVRAYLDRGIRNYWYPVAPSWQVSSAPVGITRLSEQIVLWRDREGNVHALEDRCPHRGARLSLGWNLGDRVACWYHGVEVNGGGTVTKVPAVSNCPLEGQACVKSYPVEERAGAIFLWFGDDAHREPAPLVLPDELVAPEYAQFVCVSNWTCNYQYAIDNVMDPMHGAYLHATSHSMAEGDKQADMRVRRTETGLMFEKVNQRDVNFDWVELGETGCIWLRLAIPYQRKFGPGGSFGIVGFATPIDDEHCQVYFWRTRKVAGWQRDVWRFLYRNRLEGLHWAVLEQDRYVLESMAPNARDHEYLYQHDIGVTRVRRMLRQRAQEHLAALDAHRAAQADAAERA

SEQ ID NO: 28438 - protein, 762 aa, Nicotiana tabacum
MLRTLALALLISAFLVSLSAADNGFPRCNCDDEGFWSIERILECQRISDLFIAIAYFSIPIELLYFVSCSNFPFKWVLFQFIAFIVLCGMTHLLNFWTYYGQHPFQLMLALTIFKVLTALVSFATAITLITLFPMLLKIKVREFMLKKKTWDLGREVGLIKQQKEAGWHVRMLTQEIRKSLDRHTILYTTLVELAKTLDLHNCAIWKPNENKTEMNLIHELKGRSFSSMYNLPIPTSDPDVREIKESDGVKLLDAYSPLAAASSGGSSEPGAVAAIRMPMLKVSNFKGGTPELVPECYAILVLVLPGEQGRSWSNQEIEIVRVVADQVAVALSHAAVLEESQHMRETLEEQNRALQQAKQDALRASQARNAFQMVMSHGLRRPMHSILGLLSLLQDDNMGIEQRLLVDAMAKTSSVVSTLINDVMDTSTKDNSRFPLEMRHFQLHSMIKEAACLAKCLCAHRGYNISIEVDKSLPNYVMGDERRVFQVILHMVGNLLKDPNGGCLTFRVLPESARREGIDGAWKTRRSHSSLENVYIRFEVGSSNNHSQPEGITSTLPHCCETRRSREVEERLSFSVCRKLVQLMQGDIWVVPNPEGFDQSMTVILGFQLRPSIAVGIPEYGESSDHSHPHSLLQGVNVLLADYDDVNRAVTRKLLEKLGCTVSAVSSGHDCLGALGPAVSSFQIVLLDLHLPDLDGFEVTMRIREFRSRNWPLIVGFASADEDVSGRCLQIGMNGIIRKPVLLPGIADELQRVLLQASIIT

SEQ ID NO: 28439 - protein, 519 aa, Oryza sativa
MAVTRLAVAAALSAAPPSSRRRRAFFHHSCRPLPSSAAAAAKALRASAAPAVDEEAPASPPPSDLGKGVENLVIIGSGPAGYTAAIYAARANLKPVVFEGYQVGGVPGGQLMTTTEVENFPGFPDGVTGPDLMDKMRKQAERWGAELHQEDVEFVNVKSRPFVIRSSDRECTELLWTNVFAALIPRLRLPREDEFWSRGISACAICDGASPLFKGQVLAVVGGGDTATEEAIYLTKYARHVHLLVRKDQLRASKAMQDRQHKQVLNNPNITVHFNTEAVDVVSNPKGQMSGIQLKRTDTGEESVLEVKGLFYGIGHTPNSQLLQGQIDLDDAGYILVEEGTAKTSVDGVFAAGDVQDHEWRQAVTAAGSGCVAALSVERYLVANDLLVEFHQPVREEKEKEITDRDVEMGFDISHTKHRGQYALRKVYHESPRLVCVLYTSPTCGPCRTLKPILSKVIDEYNEHVHFVEIDIEEDPEIAEAAGIMGTPCVQFFKNKEMLRTVSGVKMKKEYREFIESNK

SEQ ID NO: 28440 - protein, 637 aa, Arabidopsis thaliana
MFGPTGGLGMNPSMDDMNLIQQAQRHQLVVSNLGEEIDLEIGPGEDDAAFANNSLIGGPPREPSTGEHDETKHMVLVSDLPSEDQDISKGTPAKRKKKVVKRWREEWADTYKWAYVDMKDGTARIFCSICREYGRKHRRNPYGNEGSRNMQMSALEEHNNSLLHKEALRLQTASKDKIVVDKPIYVKTVMSKSAGSIVEGALKRDPNEIEFVQSVQESVHALERVIAKNSHYVNIMERLLEPERMIVFRVPWIDDRGETHVNRGFRVQFNQALGPCRGGIRFHPSMNLSIAKFLGFQQTLKNALSPYKLGGASGGSDFDPKGKSDNEIMRFCQSFMNEMYRYMGPDKDLPSEEVGVGTREMGYLFGQYRRLAGQFQGSFTGPRIYWAASSLRTEASGYGVVYFARLILADMNKEIKGLRCVVSGCGKIAMHVVEKLIACGAHPVTVSDSKGYLVDDDGFDYMKLAFLRDIKSQQRSLRDYSKTYARAKYFDELKPWNERCDVAFPCASQNEVDQADAINLVNAGCRLLVEGSNMPCTAEAVDVFRKANVLIAPAIAAGAGGVAAGEIEVLRESNSMQWSAEDFESRLQEALKQTYEKALKAANDFGYQKESPEALLHGATIAAFLNIAQAMTDQGCV

SEQ ID NO: 28441 - protein, 290 aa, Geobacter metallireducens
MPRSCTLIINPTSGSYSASLVDRVTARLAAAGFSPSVLLTGGPDDAAAFAARACAEEDHPFIVAGGGDGTMNGVINGLVPGRATLAFLPLGTANVCARELGIGSVDEAVRRIIRREARPLSVGLLEGFGVSRRFFLMAGAGFDGFVVEGVLGEEKKRFGKGAYLLSALRTLSAWDGRPMEVEAAGARRSCHSVIVCNAARYGGSFVLAPGASLFEPRFRVVCVEAGRRRDYLRLALRVAAGRGAAGAGVTVFDADTVTIGGNKAVQVDGDFICHGPVTIRSLPDFARLVV

SEQ ID NO: 28442 - protein, 315 aa, Bacteroides thetaiotaomicron
MEKIARKLTDLVGNTPLLELSNYNKSNGLKARLIVKIESFNPAGSVKDRVALAMIEDAEMKGVLTPGATIIEPTSGNTGVGLAFVAAAKGYKLILTMPDTMSVERRNLLKALGAELVLTPGADGMKGAIAKAEELKAATPGSVILQQFENPANPAMHLRTTGLEIWRDTEGKVDIFVAGVGTGGTISGVGEALKMRDPSVKAVAVEPADSPVLSGGKPGPHKIQGIGAGFVPKTYNASVVDEIIQVQNDDAIRTSRALAEEEGLLVGISSGAAVYAATELAKRPENEGKMIVALLPDTGERYLSTILYAFEEYPL

SEQ ID NO: 28443 - protein, 181 aa, Zea mays
MASSMLSSATVVSSPAQAAMVAPFTGLKSSAAFPVTRKTDTDITSMASNGGRVNCMKVWPPVGKKKFETLSYLPDLTDVELSKEVDYLLRNKWIPCVEFELEHGFVYREHGNTPGYYDGRYWTMWKLPLFGCTDSAQVLKEVQECKKEYPNAFIRIIGFDNNRQVQCISFIAYKPPSFTGA

SEQ ID NO: 28444 - protein, 488 aa, Methanosarcina acetivorans
MGSDFSVKDAAGKIMQPAAEVQEEVPGKGPIHVRTEKEITRVVIIGGGACGMAAATKIRRQSDFKITVLSSDSHTAYSHCGIPFVLGREIENFEKLIVKPPGFFREKNIDVKLNEKVMSINLAKRVVLTGKGTYPYDKLVIATGSLPFIPRKSKANILPYGIFTLRSLADGKLFGKALETAQTVCIIGGGIIGIECASALTKRGIKTILITRSKDLLSSQFDSDMAAIVRAHLEALGVRVITGEPLFLPENFWKEKTVYIKDRHFPADLMLLATGVKPEVCLASEAGIDTGKAGGIVVNEMLQVKAGGEFLPNVYAGGECAEVTDLLTGESRLSPLGTTARRMADVIGNNITDKYSTFGPLADPWVAVAGDLQFGGVGLTPEQVKRQGIKVVSGFSRGRTRASYYPGRKDIYIKLFFKDGCLAGAQLAGGEGIKERIDALSLAIRKKTTIKDLLNLETCYAPPVSMLVDPLTPAVKAAVRNIRKAKTE

SEQ ID NO: 28445 - protein, 625 aa, Unknown
  Streptomyces sp. JP95
MSAIAGWVDFERDLSPQAATVETMAAALAHRGPDGRGVWAEGHAALAHRRLALLDLTETGAQPAVHTTEGGAAVAVLTLDGALTNHTELRARLAAKGHRFTGRGDGETALHAYLEWGADFLTRLEGLFAIAVWDVRRQELLLARDRLGVKPLSYHPTPTGVLFGSEPKAILAHPDVDAVVDADGLRELFAHSRKPGTGVFRGMREVVPGHALIVRRPGSREQRYWSLPAREHTDSLDTTVATVRGLLADAVASHTRADAPVGAMLSGGIDSSALSALAHRDLTAAGSGPLRTFSVNFTGYTENFEPHPTMRSTPDAPFAALASRHIGSRHTEFLLDTAALTDPGVHTAALRSQDAPSPLGDMDVSLLRFFARLREEGFAAVLSGETADEVFNGYFWAYDPKHSNSQTFPWVSFERGHDAAAGGLGTSMIDRELRKRLDFLGYADQHYRDALTEVPHVDGDTAAERRAREVTYLALTRWAPTHLDRADRMSMAHGVQLRPPFCDRALVEYVYNVPAAMKRVDGVEKSLLRSAVADLLPDEVLHRRKSAYPTTQEAAYGDFVRQRFAELAADRDAAVAELLDTTATAEAVAADGSPQGAFAWVERAGMEMALQLDTWLTDYRVDLRL

SEQ ID NO: 28446 - protein, 953 aa, Oryza sativa
MLSLQQQGGGDPRPQQPAAAPALLGGADWLGFGRAAAELDESVASSPASFLLPPAPPVDARAQAQPEPKPKQLGAVDVERHLALAHQNYRSGKYKEALEHGNIVYEKNPRRTDNLLLLGAIYYQIRNYDMCIAKNEEALAIDPNFAECYGNMANAWKEKGDVDLAIRYYLTAIQLRPNFCDAWSNLASAYTWKGRLNEAAQCCRQALAINPRLVDAHSNLGNLMKAQGFIQEAYNCYIEALRIDPQFAIAWSNLAGLFMEAGDLDKALLYYKEAVKLKPSFADAYLNQGNVYKTMGMSQEAIISYQRAVQARPDYAMAYGNLATIYYEQGQLDIAIRCYNQAIICDPQFVEAYNNMGNALKDAGRVKEAINCYRSCLALQANHPQALTNLGNIYMEWNLISAAASFYKAAISVTSGLSSPLNNLAVIYKQQGNYADAITCYTEVLRVDPTAADALVNRGNTFKEIGRVNEAIQDYIQAATIRPTMAEAHANLASAYKDSGHVETAIVSYKQALRLRPDFPEATCNLLHTLQCVCDWENRNAMFRDVEEIIRKQIKMSVLPSVQPFHAIAYPIDPMLALEISCKYAAHCSLIASRFGLPSFVHPPPVPVKAEGKHCRLRVGYVSSDFGNHPLSHLMGSVFGMHDRDNVEVFCYALSQNDGTEWRQRIQSEAEHFVDVSAMTSDMIARIINQDKIQILINLNGYTKGARNEIFALQPAPIQVSYMGFPGTTGAAYIDYLVTDEFVSPTCYSHIYSEKLVHLPHCYFVNDYKQKNRDCLDPVCPHKRSDYGLPEDKFIFACFNQLYKMDPEIFDTWCNILKRVPNSALWLLRFPAAGETRVRAHAAARGVRPDQIIFTDVAMKNEHIRRSSLADLFLDTMKEYEDRAVDLALNPAKLQALTNKLKEVRMTCPLFDTARWVRNLERAYYKMWNLYCSGRHREPFKVIEDDNEFPYDR

SEQ ID NO: 28447 - protein, 277 aa, Unknown
  Candidatus Kuenenia stuttgartiensis
MEILSIAAIQMCSVHDRNKNLNTARVLMEKAVQKGARLIALPENFSFIGQERENITFAEERETGEIVHFLKKFSMKHSVAIIGGSVPLRSSSKAKVTNTCLVFDQSGVIIGSYDKIHLFDFHLDDKTVYRESHYVKHGKHIETVKLFGHIMGLCICYDLRFPELFRKLMLRGMEVLFAPSAFTMETGKDHWEILLRARAIENQCYVVAPAQYGRHNDERISYGRTMIIDPWGRIMAQCQDMEDVIVCEIDFAFLGEVRKRLPCLKHIRRKLFFLGEA

SEQ ID NO: 28448 - protein, 569 aa, Chlamydia trachomatis
MPKQADYTWGAKKNLDTIACLPEDVKQFKDLLYAMYGFTATEEEPTSEVHPGAILKGTVVDISKDFVVVDVGLKSEGVIPMSEFIDSSEGLTVGAEVEVYLDQTEDDEGKVVLSREKATRQRQWEYILAHCEEGSIVKGQITRKVKGGLIVDIGMEAFLPGSQIDNKKIKNLDDYVGKVCEFKILKINVDRRNVVVSRRELLEAERISKKAELIEQITIGERRKGIVKNITDFGVFLDLDGIDGLLHITDMTWKRIRHPSEMVELNQELEVIILSVDKEKGRVALGLKQKEHNPWEDIEKKYPPGKRVRGKIVKLLPYGAFIEIEEGIEGLIHVSEMSWVKNIVDPNEVVNKGDEVEVVVLSIQKDEGKISLGLKQTKHNPWDNIEEKYPIGLRVTAEIKNLTNYGAFVELEPGIEGLIHISDMSWIKKVSHPSELFKKGNTVEAVILSVDKESKKITLGVKQLTPNPWDEIEVMFPVGSDISGVVTKITAFGAFVELQNGIEGLIHVSELSEKPFAKIEDVLSIGDKVSAKVIKLDPDHKKVSLSIKEFLVHGGDAGHDAEEESSDRD

SEQ ID NO: 28449 - protein, 417 aa, Desulfitobacterium hafniense
MDYIKEWILPQDPEVAEAIAQEEQRQRYKIELIASENFVSRAVMAAQGSVLTNKYAEGYPGKRYYGGCEYVDIVEDLARERVKKLFGAEHANVQPHSGAQANTAVYFAMLKPGDTVLGMNLSHGGHLTHGSPVNISGMYYNFVAYGVDQVTERIDYDVVRQLALEHRPKLIVAGASAYPRQIDFARLREIADEADSYFMVDMAHIAGLVAAGLHQNPVPYAHFVTTTTHKTLRGPRGGLILCQEEFAKAIDKAIFPGIQGGPLMHVIAAKAVAFGEALKPEFVEYQKRIVENAKVLSETLAEKGFRIVSGGTDNHLMLVDVRSKGLTGKEAEYILDEVGITVNKNTIPYDPASPMVTSGIRIGTPAVTSRGMDTLAMKKIAAAIDIALSEPNEAGAAKARDMVAALCAEYPLYPNLD

SEQ ID NO: 28450 - protein, 700 aa, Xylella fastidiosa
MAKITKTFQYGKHTVTLETGEVARQASGAVIVKMDDTVLLVTVVAAKTAREGQDFFPLTVDYQEKFYAGGRIPGSFFKREGRATEKETLISRLIDRPIRPLFPEDYKNEVQIIAMVMSLDPEIDGDIPAMIGASAALSLAGIPFKGPIGAAKVGYNDGQYILNPTVSELKKSQLELVVAGTANAVLMVESEAALLSEEVMLGAVIFGHREMQKVIQVIDSLTAEAGTQPSDWVPPAKNDALVIALKEVIGGRLSDAFHIREKLQRRDAIAAVKDDVIQQLAGRLEVEGWNLAELLKEFGELEYRTMRDALLDTKVRIDGRSLEAVRPITVKVGVLPRVHGSGLFTRGETQAIVVTTLGTARDGQVIDAVTGEYKENFLFHYNFPPYSVGECGRFGVQKRREIGHGRLARRGVLAVMPSLDEFPYTIRVVSEITESNGSSSMASVCGSSLALMDAGVPVKAPVAGIAMGLVKEGERFVVLSDILGDEDHLGDMDFKVAGTSEGVSALQMDIKIEGITEEIMRQALQQAKVGRLHILGEMDKALAAPRAELSDYAPRLLTIKIHPDKIRDVIGKGGSTIQAITKDTGTQIDIQDDGTIVIASVNNAAAREAKRRIEQITSDVEPGRIYEGKVAKIMDFGAFVTILPGKDGLVHVSQISSERVERVGDKLKEGDVVRVKVLEVDKQGRIRLSIKAVEEEVASI

SEQ ID NO: 28451 - protein, 351 aa, Chlamydia trachomatis
MNVVCGKSRVGYSSFFCKSREPFSCVFKALLSKFILGVPMTHAKLVIIGSGPAGYTAAIYASRALLTPVLFEGFFSGIAGGQLMTTTEVENFPGFPEGVLGHQLMDLMKTQAQRFGTQVLSKDITAVDFSVRPFVLKSGKETFTCDACIIATGASAKRLSIPGAGDNEFWQKGVTACAVCDGASPIFRDKDLFVVGGGDSALEEAMFLTRYGKRVFVVHRRDTLRASKVMVNKAQANEKIFFLWNSEIVKISGDTLVRSIDIYNNVDETTTTMEAAGVFFAIGHQPNTAFLGGQVALDENGYIITEKGSSRTSVPGVFAAGDVQDKYYRQAITSAGSGCMAALDAERFLEN

SEQ ID NO: 28452 - protein, 676 aa, Hordeum vulgare
MFPLGARQPPPSAMDNQQQQQPPRGEHAAQPRCWEEFLHRKTIRVLLVETDDSTRQVVAALLRHCMYQVIPVENGHQAWAYLQDMQSNIDLVLTEVFMHGGLSGIDLLGRIMNHEVCKDIPVIMMSSHDSMGTVLSCLSNGAADFLAKPIRKNELKNLWAHVWRRSHSSSGSGSGSAIQTQKCTKSKSGDDSNNNSNDRNDDASMGLNARDGSDNGSGTQAQSSWTKRAVEIDSPQDMSPDQSADPPEGTCAHVNHPKSEICSNRWLPGTNNKKCQKPKETTNGDGFKGKELEIGAPGNLNTDDQSSPNESSVKPTDGRCEYLPQNNSSDTVMENLEEPIVRAADLIGSMAKNMDAQQAAARAIDAPNCSLQASEGKDTDGENAMPYLELSLKRSRSTGEGAGPIQEEQRNVVRRSDLSAFTRYNMCAVSNQGGAGFVGSCSPNGDSSEAAKTVAAQMKQGSNGSSNNNDMGSTTKSVVTKPCGNNKVSPINGNTHTSAFHRVQPWTPATAAGKDKADEVSKKNVAAAAAAAKEMGCEAQSKHPCAAADDVNGGSAGGTAQSSVVNPSGPVEGHTANYGSNSFSNNNTNNGSTAATTAAAAAVHAETGGGVDKRSNMMNMKRERRVAAVNKFREKRKERNFGKKVRYQSRKRLAEQRPRVRWQFVRQPPAPATVER

SEQ ID NO: 28453 - protein, 67 aa, Glycine max
MASSVISAPAGTTVNRAGAGMVAPFTGLKSMAGCPSRRTKNDVSSIASSGGRVQCMQVWPPVGREEV

SEQ ID NO: 28454 - protein, 376 aa, Triticum aestivum
  misc_feature (253)..(253): Xaa can be any naturally occurring amino acid
MAAQAIHQFAECITCHAWSPDHSMIAFCPNTTEVHIYKFFTDKWEKLHVLAKHDQIVSGIDWSRSSNKIVTVSHDRNSYVWTQEGQDWVPTLVILKLNRAALCVQWSPKENKFAVGSGAKSVSICYYEQENNWWISKVIRKKHESSVTSVAWHPNNIHLATTSTDGKCRVFSTIIKGVDTRGPQAGASVDWKFGEQIAQLDLSPTWAFGVRWSPSGKTLAYAGHSSMIYFVDDVEGSPAAQNLALRDLPLRDXILFVSEKMAMGVGFDCNPLIFAADETGLWSFVRYLDERKVTPSTSKASQLSEALGKLYGQSRQGSSSDTVEPSKPRGGAHENCITCIVPLRKGSESIVKRFSTSGLDGKIVVWDLENHITIPK

SEQ ID NO: 28455 - protein, 130 aa, Unknown
  Shewanella sp. MR-4
MSEFLEILTHGRRFKAAVKDLSVEELRDLAAKLDKILVERESMEAEEQQAIAARNAKIEEIRQQMEAVGLSIDDLGGVAVKAAGKKRAPRPAKYQIEVNGEVIQWTGQGRMPTVFKNEVNKGRSMDDFLI

SEQ ID NO: 28456 - protein, 328 aa, Brassica napus
  misc_feature (260)..(260): Xaa can be any naturally occurring amino acid
MSSSVRKNMERIKGPWSPEEDELLQSLVQKHGPRNWSLISKSIPGRSGKSCRLRWCNQLSPEVEHRGFSPEEDETIIRAHARFGNKWATISRLLSGRTDNAIKNHWNSTLKRKCNGVASDGYDGNIGGNGGYDGNLGEEQPLKRTASGGGVSTGLYMSPGSPSGSDVSEQSCGVPHVFKPTARSGAVTEVTASTSGEDPPTCLSLSLPWNNRCETETVRVNEPTQVNENTVTDGGYTAELFPVRKEEVEEEKGISGFGGXFMTVVQEMIRTEVRSYMADLQRGNVGGGGSIGGSGGGGVGSCMPQSVNSRRVGFREFIVNQIGIGKME

SEQ ID NO: 28457 - protein, 88 aa, Methanosarcina barkeri
MKPMLLDFSATWCGPCRMQKPILEELEKKYGDKVEFKVVDVDENQEMASKYGIHAVPTLIIQKDGTEVKRFMGVTQGSVLASELDKIL

SEQ ID NO: 28458 - protein, 578 aa, Gluconobacter oxydans
MRVCRGLRTSRSFEEACILRPISAQQDVITEVCHLIAANRAPMSPCVEVVTRHATREWDDFMKLLAVHPSALMYTRVFLRLEPLGLELVAGAARNEGHDVQIIDLQVETHEDYWKRLTDFKPDAICFSGSYLANIPEILDLCKETKQRMPGKFIFVGGHSVSFIAPDVLQLSEGAIDCILKGEGDATVGLLLEAIEKKTDLLKVPGAITVDGEGPPPIFVKSLDTVRPARDLLHHRNKYFIGTLDPAASIEFARGCPWDCTFCSAWTFYGRSYRTVSPQVIADELEALKEPGIFIVDDVAFVHQEHGMAIADEIKKRGIKKEYYLETRADVLLRNKEVFKVWSEIGLTYIFIGLEAVDEEGLKQFRKRVSLDANFEALEYARSLGLTVAINIIADPSWTRERFEAVRQWCLEIPDIVNISVTTPYPGTEIWHREARRLTTRDYRLFDIQHAVLPTTLPLPEFYKELVKTQQVLNTKHMGWEALKGTVGIATRLLLHGQTNFVKMLWKFNSVFNPKLQLSDHMRKPRYEMPVQPDVVDKIDRKALYVHGPGGRRTRALDDATEGFVDKTRMGAEAAAAE

SEQ ID NO: 28459 - protein, 460 aa, Bradyrhizobium japonicum
MESTTVKREGFRRRSPGQPICWKNSVLRSPSMPSFRNELSINDQEIAAALVGEERRQQDGVELIPSENYTYPEVLELLGSVFTNKYSEGYPGRRYYGGQQYTDEIERLARERACSLFRAEHANVQPLSGSPMNQAVYLGLLEPGDTILAMDLSHGGHLTHGAPVSHMGRLFNFIRYKTAPSNGGAIDFDELRAIAREARPKMVLCGYSSYPRDLDYAAFKSIADEVGALTMADVSHYGGLVAANVMRNPLDAGFDVMTTTSHKTLRGPRGGIILCRKENAGRIDASVFPGLQGGPHMNVVAGIAVTLKKAATSDFQVYARQVLRNAKVLAGALMERGMKLVTDGTDNHMMVVDTAASVGLDGRAAEDVLDAIAITTNKQVIPDDPRPPLRPSGIRLGTPAATTRGMGEPEMRRIGEFIAAALQANGNDVVVARLRSECVEMCRAFPVPGVMSRANSVAKT

SEQ ID NO: 28460 - protein, 438 aa, Coprinopsis cinerea
MNIPFLDEVMGAEQGVGRVDDFIGELWRGWKRLRDEGKLPQPLHLGLFRSDYLLHIPGDQKPSLKQVEFNTISISFGCLAQRVAELHRYQLAATSYFDSSPYLQRDNFPPNESISGLAEGLATAHKAYVSQGGNPRSKILFVIQPGERNVFDQKWLEFELLEKHSIHVLRQTFDDLITSAKVENETLTVSSTTEISVVYYRSGYMPHEYPTPAHYTVRLILESSKAINCPTIALQLAGGKKVQEVLTRPGVVEKFLPEFSAEQIAELRGSFMDMWGLDEDSQDAVGSTETGGQGKSEPLGTTKARKEFASLVLKPQREGGGNNVYKDDIPAFLDKLPPEEREAWIAMRLIEVPQGVRGWLLRAGSVGYSSDTLSAHNAVEAEVVSELGIFGWALFGKDGEKEKIEEKEVGWLVRTKGKDSNEGGVATGFSVLDSLVLV

SEQ ID NO: 28461 - protein, 434 aa, Oryza sativa
MTRAVADVSAARSALQVLGPRPDHELVDSSRAIVAATDAEAGGSRRVPEGDLEACRAVVRLEETHDAYEALLQEAEGRLEAVYRSAMEGKDLEEPDGRDESAAAAAGDDAAVQEEVIAVLRQAEEGKPVESVRLVDRQLRHLPEAFGRIQGLRVLDVSRNQLEVIPDAIGGLDHLEELRLASNALISLPDSIGLLLNLRILNVGSNRLRSLPDSISKCRSLIELDASYNGLAYLPTNIGYELVNLRKLWVHMNKLRSLPSSICEMRSLYLLDAHFNELCGLPSAIGKLSSLEILNLSSNFSDLKDLPASFGDLLNLRELDLSNNQIHALPDNFGRLDKLEKLNLEQNPLSMPPMEIVNKGVDAVKEYMLQRWLDILLEEERKSIAAAESPQAPTTPSAWLARSVSWVSDVSGSLVGYLSGENKTEKDAYLDQQY

SEQ ID NO: 28462 - protein, 555 aa, Vibrio fischeri
MCSIFGILDIKSDPTPLRTTALEMSKKLRHRGPDWSGIYSSDKAILAHERLAIVGLNSGAQPLYSEDKKHILAVNGEIYNHKELREKYADNYTFQTDSDCEVILALYREKGADLLEDLNGIFAFILYDEEKDEYLIGRDHIGIIPMYHGYDEHGNYYVASEMKALVPVCKSISEFPPGHFYSSKDTEPTRYYLRDWMDYDAVKDNPTSKEDLTQALEDAVKRQLMTDVPYGVLLSGGLDSSITSAVAKRFAAMRIEDDEKSEAWWPQLHSFAVGLEGAPDLKAAREVADKLGTVHHEMTYTIQEGLDAIRDVIYHIETYDVTTIRASTPMFLMGRKIKAMGIKMVLSGEGADEIFGGYLYFHKAPNKKEFHEETVRKLLALNMFDCARANKSLAAWGVEGRVPFLDKEFIDVAMRLNPQDKMCGNGKMEKHILRECFEHYLPEAIAWRQKEQFSDGVGYSWIDTLRETAEAKVTDQQMESAKFRFPYNTPTTKEAYVYREIFEELFPLEDAAKCVPGGPSVACSSAKAIEWDESFQNCVDPSGRAVQAVHNEAYD

SEQ ID NO: 28463 - protein, 348 aa, Glycine max
MAKYHSSGKSSSMTAIAFLFILLITYTGTTDAQSGVCYGRLGNNLPTPQEVVALYNQANIRRMRIYGPSPEVLEALRGSNIELLLDIPNDNLRNLASSQDNANKWVQDNIKNYANNVRFRYVSVGNEVKPEHSFAQFLVPALENIQRAISNAGLGNQVKVSTAIDTGALAESFPPSKGSFKSDYRGAYLDGVIRFLVNNNAPLMVNVYSYFAYTANPKDISLDYALFRSPSVVVQDGSLGYRNLFDASVDAVYAALEKAAGGGSLNIVVSESGWPSSGGTATSLDNARTYNTNLVRNVKQGTPKRPGAPLETYVFAMFDENQKQPEFEKFWGLFSPITKQPKYSINFN

SEQ ID NO: 28464 - protein, 265 aa, Petunia sp.
MATSAIQQSAFAGQTALKSQNELVRKIGSFGGGRATMRRTVKSAPQSIWYGEDRPKYLGPFSEQTPSYLTGEFPGDYGWDTAGLSADPETFARNRELEVIHCRWAMLGALGCVFPEILSKNGVTFGEAVWFKAGSQIFSEGGLDYLGNPNLIHAQSILAIWAAQVVLMGFVEGYRVGGGPLGEGLDKIYPGGAFDPLGLADDPEAFAELKVKEIKNGRLAMFSMFGFFVQAIVTGKGPIENLYDHVADPVANNAWAFATNFVPGK

SEQ ID NO: 28465 - protein, 552 aa, Coprinopsis cinerea
MSGKLASSYASWAELQKIYDHQHSKLVLKDLFAQDPERFKKFSKEYTSSTNPETTILLDYSKNLITEPILAKLLDLAREAGVEEWRDKMFAGEHINNSEGRAVLHVALRAFGEINTTEEGVSQVGSVLAHIKEFTEAVRSGQWKGYTGKSIDTIVNIGIGGSDLGPVMVTEALKPYSKRDLKAKFVSNVDGTHIAEVLRECNPETTLFIIASKTFTTQETITNAETARSWFLDTAKDKAHVAKHFVALSTNTKAVTAFGISEQNMFQFWDWVGGRYSLWSAIGLSIALVIGYENFEALLKGAHGMDMHFREAPLERNLPVLLAVIGIWYNDFYGSQTHALLPYDQYLNKFADYFQQGDMESNGKSVTKNGERVNYQTGPIIWGASGTNGQHSFYQLVHQGTKLIPADFIAPATTHNPINHSKHHRILLSNFFAQPEALAFGKTEEEVRAELGSGAAEEVVKSKVFEGNRPTNSIMFPLLTPEVLGALIALYEHKIFTQGVIWGINSFDQMGVELGKVLAKKILAQLEKPEDVQGHDSSTTGLIHYYQKWRKE

SEQ ID NO: 28466 - protein, 564 aa, Lachancea kluyveri
MSEITLGRYLFERLKQVQVQTIFGLPGDFNLSLLDKIYEVPGLRWAGNANELNAAYAADGYARVKGMSCIVTTFGVGELSALNGIAGSYAEHVGVLHVVGVPSVSSQAQQLLLHHTLGNGDFTVFHRMSSEISETTAVITDIKDAPKEIDRCIKVTYSKQRPVYLGLPANLVDLKVSASLLDTPIDLSMTPNDADAEDEVVETVLAMVSKAKNPVILADACCTRHDVKRETKKLIDLTQFPAFVTPMGKGSIDEDHPRFGGVYVGTLSDPEVKEAVESADLVLSVGALLSDFNTGSFSYSYKTKNIVEFHSDYTKVRNATFPGVQMKLVLQKLLSKVSDAASGYKPVPVPKGTRSNPGVESSTPLKQEWIWNHISDWLEEGDVVITETGTSAFGINQSRFPNSTYGISQVLWGSIGYSVGSCLGAAFAAEELDKNRRVILFVGDGSLQLTVQEISTMVRWGLKPYLFVLNNDGYTIERLIHGETAQYNDVQPWLHLNLLPTFGAKDYDSIRISTTGEFLKLTEDQAFSRNSKIRLIEVMLPVMDAPSTLVKQAQLTAATNAKQG

SEQ ID NO: 28467 - protein, 207 aa, Arabidopsis thaliana
MENMSNLTSKFLLNPLNVHKHCAVSDENGDRKSHVLKQVCSCICCCNRRNKTQARSQKGSYFIKGKVHPVSRMEKWEEKITEANSHGKIIARHDLILCNMEQLVVNFKASWCLPSKTILPIYQELASTYTSMIFVTIDVEELAISKLSDLGVKICLIQEFSHEWNVDATPTVVFLKDGRQMDKLVGGDAAELQKKTAAAANLLLRQS

SEQ ID NO: 28468 - protein, 462 aa, Oryza sativa
MDPCPFVRVLVGNLSLKMPVAPRPAGAGAGVHPSTSPCYCKIRLNKLPYQTADAPLLLPPSPEASAAPAPAPATGALAAAFHLSKADLDRLTAKPSLFGSRTARLKIVVYAGRRGTTCGVGGGSGRLLGKVVIPLDLKGASAKPVVYHSSWICIGKRGRKPSSVSAANAQLNITVRAEPDPRFVFEFDGEPECSPQVLQVQGSMKQPMFTCKFSCRSNSDLRSRSMPADMGSGGRNWLTAFGSDRERAGKERKGWSVTVHDLSGSPVALASMVTPFVASPGTDRVSKSNPGAWLVLRPGDGTWKPWGRLECWRERGAGAAAGDSLGYRFELVLPDPTGMGVGVSVAESTIPASKGGRFAIDLTATQQFGRSGSPACSPCGSGDYGMWPFGSCRGFVMSAAVQGEGKCSRPAVEVGVQNVGCAEDAAAFVALAAAVDLSMDACRLFSHRLRRELSASRSDLLR

SEQ ID NO: 28469 - protein, 577 aa, Lachancea kluyveri
MSTMQLGTYLFYRLSQVTKTVFGVPGDFNLNLLEHVYNFDESQIKWCGNANELNAGYAADGYSRINKFGCFITTYGVGELSALNAVSGAFAENAPVLHIVGTSSMLAKRGACPLNQIHHLIPPKKTYEAPDHKVYEKLAEPFSIHTESLSDENLEKIQDQIDSVIESIFCHMKPGYLFIPSNLPDAEIPVDLNKQLNFDFITKLRVDPHATSEMVSLTLKRIYSSRNPGFIVDQFMRFDLEKLNLFLEKFNFYCYNTTTARGFADESLPNFHGVFNNELSTNGTLEILDQNDFILHLGTNINEVSYFVGGSTPLDKKDVIFIGKDYAQVGTNGHIITGINCHVFFEELLQRMNSKTMPKVKTRKSTALYNNGYTVDDDSKTVTQANLSQVVSAQLRENDVIINEMCSFMFEMPNIKYSKGCQFVGQPFYGSIGYALPATLGASLAIKDYKKSGRVILFQGDGSAQMTLQELASYIRFEIDPIIFMLNNSGYSVERVIKGPTRSYNDIIVDWDWCNILSVFGDRNGDRSTSYKVEKLGELKNVLTKRLDYSDGKIKMVEIILDRMDVPFGFKKLIGAN

SEQ ID NO: 28470 - protein, 278 aa, Pyrus pyrifolia
MATTMASCGIGSRCAFAGAQLSSVKPQNNQLLGVGGAHGEARLTMRKATGRKSVAASIDSPWYGPDRVMYLGPFSGEPPSYLTGEFPGDYGWDTAGLSADPETFAKNRELEVIHSRWAMLGALGCVFPELLARNGVKFGEAVWFKAGAQIFSEGGLDYLGSPQLIHAQSILAIWACQVILMGAIEGYRVAGGPLGEVTDPIYPGGNFDPLGLADDPDAFADVKVKEIKNGRLAMFSMFGFFVQAIVTGKGPIENLADHLADPVNNNAWAYATNFVPGK

SEQ ID NO: 28471 - protein, 508 aa, Zea mays
  misc_feature (242)..(242): Xaa can be any naturally occurring amino acid
MVSERQQAAGKVAAFNLTEAGFGDGSDLLDDDGRERRTGTLVTASAHIITAVIGSGVLSLAWAIAQLGWVIGPVVLLAFSAITWFCSSLLADCYRAPPGPGQGKRNYTYGQAVRSYLGESKYRLCSLAQYVNLVGVTIGYTITTAISMGAIKRSNCFHSRGHGADCEASNTTNMIIFAGIQILLSQLPNFHKLWWLSIVAAVMSLAYSSIGLGLSIAKIAGKLMHGSYCTYVLSLILSRDFXLTAGGVHVKTSLTGAAVGVDVTAAEKVWKTFQSLGDIAFAYTYSNVLIEIQDTLRSSPPENVVMKKASFIGVSTTTAFYMLCGVLGYAAFGSDAPGNFLTGFGFYDPFWLIDVGNVCIAVHLVGAYQVFCQPIYQFVEAWARGRWPDCAFLHAELAVVAGSSFTASPFRLVWRTAYVVLTALVATVFPFFNDFLGLIGAVSFWPLTVYFPIQMYMAQAKTRRFSPAWTWMNVLSYACLFVSLLAAAGSVQGLVKDLKGYKPLFKVS

SEQ ID NO: 28472 - protein, 727 aa, Pseudomonas syringae
MNTKSTPTAEDNSAPQDNPGSTPSRIREGLPFPLGASWDGLGVNFALFSANATKVELCLFDSTGEIELERIELPEYTDETYHGYLPDAHPGLIYGYRVYGPYDPKNGHRFNHNKLLIDPYAKQLVGELKWSEALFGYTIGHPDGDLSFDERDSAPFVPKSKVIDEAYTWGRDQRVGTPWDKTIFYETHVRGITMRHPEVAEELRGTFAGLGSAPVVDHIRKLGVTSVELLPIHAFVNDQHLLQKGMTNYWGYNSIAFFAPDPRYLASGKIAEFKEMVAHLHHAGLEVILDVVYNHTAEGNELGPTLSMRGIDNASYYRLMPDDKRYYINDSGTGNTLDLSHPCVLQMVTDSLRYWASEMHVDGFRFDLATILGRYHDGFDERHSFLVACRQDPVLRQVKLVAEPWDCGPGGYQVGGFPPGWMEWNDKFRDTVRAFWKGDEGQLADFAARMTASGNMFNQRGRRPQASVNFITAHDGFTLHDLVSYNDKHNEANDENNQDGSNNNLSWNHGVEGPTEDAEINTLRLRQMRNFFATLLLAQGTPMIVAGDEFARTQHGNNNAYCQDSEIGWINWDLDEDGAALLKFVTRVIKLRQTYPILRRSRFLVGDYNEEIGVKDVTWLAPDGNEMSVEQWHDANGRCLGMLMDGRAQETGIRRPGADATLLLVVNAHHDGVNFTLPEVPEGTHYECLIDTNQDDARSKEHFAFGSQYTVTPRSLLLFELKREDQQ

SEQ ID NO: 28473 - protein, 641 aa, Oryza sativa
MPPKRQRSAAGPSGEAPVNSLDDGCLMHIFSFLSPIPDEDVTKHLLQGMIRRVCLSARNCEFMTPRVSNTPPDRYNTALVCHRWRFLACHPRLWLRVERPIRNTIEPGVYPNLESAVSAARPGDTILIAAGGTHVARNIQIKKPLCIQFFFVVDATLSLRLSFAYCQIGGGELPDDTVLTCSRGSDNALEFHSTCKIANLTIRAELGCCLLHRSGRLTIEECLLQCEQNPLDYLSFPIISTAIEYDSFSSLKEQGHGVTVVRTRIEGGAKAVRTNGTLALQHVRAIYSRSSVFFWFEVGERHLARDTVHFDIKLLWAQPDVPASSSEVSMMDSISIGLSMASVTYLDDAHSEVIDPPKNEEMLDVTELVDDHTQHSPKPNAMVSGNVRELLECPVCLNAMYPPIHQCSNGHTLCSGCKPRVHNRCPTCRHELGNIRCLALEKVAASLELPCKYQNFGCLGIYPYYCKLKHESQCQYRPYTCPYAGSECTVAGDIQYLVSHLKDDHKVDMHNGSTFNHRYVKSNPHEVENATWMLTVFSCFGQYFCLHFEAFQLGMAPVYIAFLRFMGDDAEAKNYSYSLEVGGSGRKMTWQGVPRSIRDSHRKVRDSYDGLIIQRNMALFFSGGDKKELKLRVTGRIWKEQ

SEQ ID NO: 28474 - protein, 187 aa, Methylococcus capsulatus
MNRLEEIRQVETAAERLYSEAEVENAIVRLAAEITEAIADRNPIVMTILTGGIVFAGKLLTHLRFPLELDAIGATRYRGRTAGGVTHWRLEPGLSLQGRTVLLVDDILDEGVTLAEVREHCLDRGAERVLIAVLVDKDLGREKPCRADFVGLVTENRYLFGYGLDYKGYLRNAAGIYACPQIESQGT

SEQ ID NO: 28475 - protein, 502 aa, Xylella fastidiosa
MHNGFDALQLHANRLRGVTIPDLLAAELKRPEQYARQVGPLYFNFARQKYDCVALEALFALARNHNVTGAFQRMFCGEQVNVTEGRAVLHTALRGDLSGTSVAVAAYTAAAKVRERMYALIAGLDASEVTDIVSVGIGGSDLGPRLVVDALRPISQGRFRVHFVSNVDGAAMRRTLDMLDPSRTAGILISKTFGTQETLLNGRILYDWLGGSERLYAVSANPERAVHAFDIVPTQVLPIWDWVGGRYSLWSAVGFPIALAIGSQRFEELLAGAAEFDAYALRVPLEENVAVLHGLTAVWNRNFLGCATYAVMAYDQRLALLPAYLQQLVMESLGKRVKCDGTPVDRDTVPVWWGGVGTDVQHSFFQALHQGTNIVPADFIGTIRNDDLYTENHFALNANLLAQIEVLANGQLSDDPHRVYPGGNPSTLILLDALTPQALGGLIAMYEHSVYVQSVIWGINAFDQFGVELGKHLAVQLLPALKGESVEVVDPVTRAVLVRLRG

SEQ ID NO: 28476 - protein, 412 aa, Glycine max
MNALAATNRNFQRAARILGLDSKLEKSLLIPFREVKVECTIPKDDGTLVSYVGFRIQHDNARGPMKGGIRYHPEVDPDEVNALAQLMTWKTAVADIPYGGAKGGIGCNPRDLSISELERLTRVFTQKIHDLIGIQKDVPAPDMGTNAQTMAWILDEYSKFHGHSPAVVTGKPIDLGGSLGREAATGLGVVFATEALFAEYGKSISDHTFVIQGFGNVGTWAAKSIFERGGKVIAVSDISGAIKNLNGIDILALLKHKDGNGGVLKDFPGAEAMDPDELLVHECDVLVPCALGGVLNKENAADVKAKFIIEAANHPTDPDADGILSKKGVIILPDIYANAGGVTVSYFEWVQNIQGFMWDEEKVNRELKKYMTKAFQDIKAMCKIHNCDLRMGAFTLGVNRVARATLLRGWEA

SEQ ID NO: 28477 - protein, 263 aa, Campylobacter jejuni
MVSMRDLLECGVHFGHQTRRWNPKMKKFIFGERKGIYVIDLQKTLRYFRYTYNIVRDAAAEGKTILFVGTKKQAGGAIKEYAEKCGMPYVNHRWLGGMMTNFGTIRQSIRKLEVIEKMEEDGSIKLLTKKEALMLTRKKEKLLAYLGGIRYMKTQPDMIFVIDTVKEKIAVQEANRLRIPVVAPLDTNCDPDLVTYPIPGNDDAIRSVQLFCQEMAEAINEGKALREQDGEALANEEKEITDEEKKEVLDEAMSEEDFGEEQE

SEQ ID NO: 28478 - protein, 964 aa, Leptospira interrogans
MNSTLQNQTKTNLEKVGTDPLDTFPRRHIGPNLQQTAEMLKELGLSSVEELIDKAVPVGIRLKKSLDLPKASTEHKILQNLKGIASQNQVFRSYIGAGYHSCIIPGVIQRNILENPGWYTAYTPYQAEISQGRLEALLNFQTMIIDLTGLEISNASLLDEGTAAAEAMFLAYSVRKNETAKKFFVSELCHPQTIDVVVTRANPLGIEVQIGNHESIELNEDFFGVLLQYPATDGKIIDYTSFIQRSHNVGAISTVAADLLALTLLKSPGEMGADIAVGSSQRFGLPLGFGGPHAGYFATKDEFKRSMPGRLIGVSKDSQGNSGLRLSLQTREQHIRRDKATSNICTAQVLLAVISSMYAVYHGPEGLKNIATRIYKFTSIFANVLKNAGFSITNEFFFDTITIQAGTKVQEILNRAYSKKINFREYKDGKIGITLDETVNLEDLKDLLEIFEIKNTDIEKLFVDVSNVPDSFKRKTSYLTHPVFQSHHTETKMLRYIRKLESRDLSLTTSMIPLGSCTMKLNATTEMYPVTWPEFGAIHPFAPADQTKGYKIIFEQLEKWLCEITGFAGVSLQPNAGSQGEYAGLLAIRRYHESRNESYRNVCLIPISAHGTNPASAAMAGFQVVVVSCDPNGNVDLEDLKAKAEEHKKDLAALMITYPSTHGVFEESVKEICQIVHSCGGQVYMDGANMNAQVGLTSPGEIGADVCHLNLHKTFCIPHGGGGPGVGPIGVAKHLVPFLPGHVLVDNATGNEHGAVSAAPWGSASIVLISWVYIALMGSEGLTNATRNSILNANYIAKRLEKVYPVLYKGKNGFVAHECILDLRPFKKSAGIEVEDVAKRLIDYGFHAPTMSFPVPGTLMIEPTESESLEELDRFCEAMLLIYQEILDVQSGTLDKTDNPLKNSPHTAAMVTSDRWDHLYPRERAAYPASWLKDHKFWPYVGRVDNVYGDRNLVCSCLPIESYQ

SEQ ID NO: 28479 - protein, 220 aa, Brassica rapa
MGTPESSREPCPDRILDDIGGAFGMGAVGGSAFHFLKGTYNSPKGSRFLGGKQAVAMNAPRLGGSFAVWGGLFSTFDCSMVYLRQKEDPWNSIIAGAATGGFLSMRQGPNAAVRSALVGGVLLALIEGAGIALNKMMAEPQHMQMEEGMAGVPGIQMGQQQQQVPNQGQMIPPPENTASSSWFGGLFGKKNEETQPTSSGSETKVLESFDAPPVPSFEYK

SEQ ID NO: 28480 - protein, 158 aa, Glycine max
  misc_feature (98)..(98): Xaa can be any naturally occurring amino acid
  misc_feature (100)..(100): Xaa can be any naturally occurring amino acid
  misc_feature (115)..(115): Xaa can be any naturally occurring amino acid
  misc_feature (130)..(130): Xaa can be any naturally occurring amino acid
MDSSLISFPAVTTVNRAGAGMVAPFTGLKYMAGFPTIKTNNDITSIASNGGRVQCMHVWPPLGKKKLETLYYLADLDDAQLLEEVEYLLRKGWIPCLXIXLEHGFLYREHNRLPXYYDGRYCTMCKLPMXCCTDASQVSEELQEATTAYSSCFMRIIA

SEQ ID NO: 28481 - protein, 301 aa, Unknown
  Nocardioides sp. JS614
MHIGLVGLGKMGGNMRTRLRDAGHTVVGFDRNPDLADVDSLEAMVEQLPSPKVVWVMVPAGDPTRETIRRLGELLDEGDLVVDGGNSKWTDDQENADLLAQRGVGFVDCGVSGGVWGAKFGYALMCGGSDEDVAKVQPAFDALKPDEGGFVHAGKKVGAGHFAKMVHNGIEYAMMQSYAEGWELLEKVDLVDNVTEVFDSWRSGTVIRSWLLDLLVTALEEDGHLDQITGYADDSGEGRWTVQAAIDNAVPMHVIAASLFARFTSRQDDSPAMKAVAAMRNQFGGHAVHTEPPVGGDANPG

SEQ ID NO: 28482 - protein, 443 aa, Citrobacter freundii
IGVVGMAVMGRNLALNIESRGYTVSIFNRSREKTEEVVAENPGKKLVPYYTVKEFVESLETPRRILLMVKAGAGTDAAIDSLKPYLDKGDIIIDGGNTFFQDTIRRNRELSAEGFNFIGTGVSGGEEGALKVPSIMPGGQKEAYELVAPILTKIAAVGKDGEPCVTYIGADGAGHYVKMVHNGIEYGDIQLIAEAYPLLKGGLNFSNEELATTFTEWNEVRLSSYLIDITKDIFTKKDEEGKYLVDVILDEAANKGTGKWTSQSSLDLGEPLSLITESVFARYISSLKDQRVAASKVLSGPRLKLAGDKAEFVEKVRRALYLGKTVLYAQGFSQARAASDEYHWDLNYGEIAKIFRTGCIIRAQFLQKITDAYAEKKGIANLLLAPYFKNIADEYQQALRDVVAYAVQNGIPVPTFSAAVAYYDSYRFAVLPANLIQAQRDYF

SEQ ID NO: 28483 - protein, 337 aa, Ashbya gossypii
MQGSVRAIRSLARQFRTMSVEKIYYPRKVQTAASDASLTLNHTSFRIKDPKVSVPFYEKHFGMQLLQKLEFPEQQRDVYVMSFPKQVNKLENGAPGIFHLSGTLHLAHSHGTENDAGYRPNNGNEEPHRGFGHICFSVADLPKECERLEAEGVAFKKRMSDGRQKNIAFALDPDGYWIELIQYNLSDAEPVDLGPKFNHTMLRVKDATKSLEFYQNVLGMSLLEVSEHANAKFTLYFLGYPAADERLKRESILELTHNWGTEDDADFSYHNGNAEPTGYSHMGVSLSDPAPLCADIEETYPDLEWELRYNKGSIKNLAVLRDPDGYHIQVLPRTWSL

SEQ ID NO: 28484 - protein, 358 aa, Cryptococcus neoformans
MSQLIATKRVDLLAPYLALDQGSRVQAEYIWIDAEGGIRSKTMTLDKAPSSVADLKEWNFDGSSTNQAPADNSDVFLRPVAIFKDPFRGGANILVLCECYDNDGTPNKSNYRAHCKKVMDAAKDTEPWFGLEQEYTLFDADGQVFGWPKNGFPGPQGPYYCGVGAGKVFARDFIEAHYRACLYAGIKISGINAEVMPSQWEFQVGPCTGIEMGDHLWMARFLLLRIGEEWGITPSLHPKPLKGDWNGAGCHSNYSTKDMRTPGKGMAAIEDAIKKLEKKHLEHIAVYGEDNDLRLTGKHETASMTTFSAGVANRGASIRIPRHVGAQGYGYLEDRRPASNVDPYRVTAILVETTVLNN

SEQ ID NO: 28485 - protein, 443 aa, Salmonella enterica
IGVVGMAVMGRNLALNIESRGYTVSVFNRSREKTEEVIAENPGKKLVPYYTVKEFVESLETSRRILLMVKAGAGTDAAIDSLKPYLEKGDIIIDGGNTFFQDTIRRNRELSAEGFNFIGTGVSGGEEGALKGPSIMPGGQKDAYELVAPILTKIAAVAEDGEPCVTYIGADGAGHYVKMVHNGIEYGDMQLIAEAYSLLKGGLNLSNEELANTFTEWNNGELSSYLIDITKDIFTKKDEDGNYLVDVILDEAANKGTGKWTSQSALDLGEPLSLITESVFARYISSLKAQRVAASKVLSGPKAQPAGDKAEFIEKVRRALYLGKIVSYAQGFSQLRAASDEYHWDLNYGEIAKIFRAGCIIRAQFLQKITDAYAENAGIANLLLAPYFKKIADEYQQALRDVVAYAVQNGIPVPTFSAAVAYYDSYRAAVLPANLIQAQRDYF

SEQ ID NO: 28486 - protein, 443 aa, Salmonella enterica
IGVVGMAVMGRNLALNIESRGYTVSVFNRSREKTEEVIAENPGKKLVPYYTVKEFVESLETPRRILLMVKAGAGTDAAIDSLKPYLEKGDIIIDGGNTFFQDTIRRNCELSAEGFNFIGTGVSGGEEGALKGPSIMPGGQKDAYELVAPILTKIAAVAEDGEPCVTYIGADGAGHYVKMVHNGIEYGDMQLIAEAYSLLKGGLNLSNEELASTFTEWNNGELSSYLIDITKDIFTKKDEDGNYLVDVILDEAANKGTGKWTSQSALDLGEPLSLITESVFARYISSLKANRVAASKVLSGPKAQPAGDKAEFIEKVRRALYLGKIVSYAQGFSQLRAASDEYHWDLNYGEIAKIFRAGCIIRAEFLQKITDAYAENAGIANLLLAPYFKKIADEYQQALRDVVAYAVQNGIPVPTFSAAVAYYDSYRAAVLPANLIQAQRDYF

SEQ ID NO: 28487 - protein, 443 aa, Salmonella enterica
IGVVGMAVMGRNLALNIESRGYTVSVFNRSREKTEEVIAENPGKKLVPYYTVKEFVESLETPRRILLMVKAGAGTDAAIDSLKPYLEKGDIIIDGGNTFFQDTIRRNRELSAEGFNFIGTGVSGGEEGALKGPSIMPGGQKDAYELVAPILTKIAAVAEDGEPCVTYIGADGGGHYVKMVHNGIEYGDMQLIAEAYSLLKGGLNLSNEELANTFTEWNNGELSSYLIDITKDIFTKKDEDGNYLIDVILDEAANKGTGKWTSQSALDLGEPLSLITESVFARYISSLKAQRVAASKVLSGPKAQPAGDKAEFIEKVRRALYLGKIVSYAQGFSQLRAASDEYHWELNYGEIAKIFRAGCIIRAQFLQKITVAYAENAGIANLLLAPYFKKIADEYQQALRDVVAYAVQNGIPVPTFSAAVAYYDSYRAAVLPANLNQAQRDYF

SEQ ID NO: 28488 - protein, 686 aa, Oryza sativa
MALHLQYVAVLLSVLTLFLATSDAVLNCSTTAGNNSSTFTVDPRRKSQNNVYQTPSPSLSPPRSNNHAPFVPAGNQQGSGFNTKSFSTTVVAGSITAAIAVVAGVVVLLVCFMRKRARFNHHRLNRKTEILIEMPMEEEVHNTRRFSYAHLLAATENFSDSRKIGQGAFGAVYKAQLMNWTTPVAVKRIMRVADHERAARDYDNEIKVISKLSHPNLVPFVGSCDENGELLLVYDLIHNGTLDYHLHYANTILSWGRRYKIALGMASALNYMHGNHPRVLHRDIKPGNVMLDEEFNAKVGDFGLVRQVPIDKTSCPMTIFGSSRYIDPQYCSTGCISPASDIYSFGVVLLEIASGEIPQCLKGNGLVEKFRRLYYSNSLLDAVDRRLNGDFDEEQMKRVILIGLLCVQFDHHMRPSMARREALLFGGRVAAARAPVRLARRGVSAGAEAGGSSSAAAAAQVIGQDEAVEWVKKDRRRMLHVVYRVGDLDKTIKFYTECLGMKLLRKRDIPEERYTNAFLGYGPEDSHFVVELTYNYGVESYDIGTAFGHFGIAVEDVAKTVDLIKAKGGTVTREPGPVKGGKSVIAFIEDPDGYKFELIERGPTPEPLCQYLVFIIIIHSATNLYYIFIIRHLAWNFSGNETIPNTRISCVMFVLFFVFTHESGNKIYFSGTVAIQAMDKGHCQKD

SEQ ID NO: 28489 - protein, 764 aa, Methanosarcina barkeri
MADREKITAKLKVAEADQRDVGKGIVRVDDSFREKLGLKPFDVVEIRGGKSTSALLGRPYPSDSGLDIIRMDGLIRTNAKTSIGEYVDIRKADWKEARSVTLAPVAKGMQIYAPSETLKAIFMNRTVSKGDFISTTSLRRSRERETLGKGIMFEDFFQDFFGPGMGQSFGLGEIKLQVVSTSPSGIVKITDMTEVELLPEAAEITPEQNVPTVMYEDLGGVKEAITKIREMIELPLKHPELFDRLGIDAPKGVLLYGPPGTGKTMLAKAVANETDAYFISVNGPEIMSKYYGESEKGIRDVFEDAEKNAPAIIFLDEIDSIAPKRAEVTGEVERRVVAQLLSLMDGLKARKNVIVIGSTNRPEAIDMALRRPGRFDREIELRVPDTEGRLEIFQIHTRGMPLAENVNLMDFAQITYGFVGADIAALCREAAMSSLRRILPKINLNEPEIPSEILDTLRVTREDFENALKDVQPSAIREILIEIPNVSWEDVGGLEGVKQLLKEAVEWPLKSPESYRDIGVEAPKGVLLYGPPGTGKTLLAKAIAHESEANFITAKGSDLLSKWYGESEKRIAEVFSRARQVAPSIIFLDELDSLAPIRGAAIGEPQVTARILNQLLSEMDGLEELRAVVVIGATNRPDIIDPALLRPGRFDELILVPVPDAGARKEIFRVHTAKMSLAEDVDIDKLVSMTDQYTGADIAAVCKKAGRDALREDLHAKEVKQKHFLQAIAETGPSVTPDTMKYYQAVQSGLRKRQSKEIETPFYT

SEQ ID NO: 28490 - protein, 131 aa, Mycobacterium leprae
MDQVQQSFYDAIGGAETFKAIVSRFYAQVPEDEILRELYPADDLAGAEERLRMFLEQYWGGPRTYSSQRGHPRLRMRHAPFRITAIERDAWLRCMHTAVASIDSHTLDNEHRRELLDYLEMAAHSLVNSAS

SEQ ID NO: 28491 - protein, 443 aa, Salmonella enterica
IGVVGMAVMGRNLALNIESRGYTVSVFNRSREKTEEVIAENPGKKLVPYYTVKEFVESLETPRRILLMVKAGAGTDAAIDSLKPYLEKGDIIIDGGNTFFQDTIRRNRELSAEGFNFIGTGVSGGEEGALKGPSIMPGGQKDAYELVAPILTKIAAVAEDGEPCVTYIGADGAGHYVKMVHNGIEYGDMQLIAEAYSLLKGGLNLSNEELASTFTEWNNGELSSYLIDITKDIFTKKDEDGNYLVDVILDEAANKGTGKWTSQSALDLGEPLSLITESVFARYISSLKAQRVAASKVLSGPKKQPAGDKAEFIGKVRRALYPGKIVSYAQGFSQLRAASDEYHWDLNYGEIAKIFRAGCIIRAQFLQKITDAYAENADIANLLLAPYFKKIADEYQQALRDVVAYAVQNGIPVPTFSAAVAYYDSYRAAVLPANLIQAQRDYF

SEQ ID NO: 28492 - protein, 548 aa, Marchantia polymorpha
MGNCVGGHSDRKNALNPNEPAATNVQRGTGAPQGSHGGSGAAGVSAQASHPAPLGGISAKQKPTLTGNVLGRPLEDVRSIYTLGRELGRGQFGVTHLCTHKVTGELLACKSIAKRKLTNKDDVEDVRREVQIMHHLEGQKNIVELKGAYEDKHNVHLVMELCAGGELFDRIIQRGHYSERAAAALCRTIVQVVQTCHSLGVMHRDLKPENFLLANKKEDAPLKATDFGLSVFFKPGEVFTDIVGSAYYVAPEVLRRNYGPEADVWSAGVILYILLCGVPPFWAETEQGIFDAVMHGHIDFTSDPWPSISQKAKDLVKRMLKQNPKERLTAHEVLSHPWISVDGEAPDKPLDNAVLSRLKQFTAMNKLKKLALKVIAESLSEEEIMGLKEMFKSMDTDNSGTITFEELKDGLQKQGSNLAESEVRQLMAAADVDGDGTIDYLEFITATMHLNKIDKEDHLYAAFQHFDGDNSGFITMEELEQALIKHGMGDPDTLKEIIREVDTDHDGRINYDEFVAMMRKGTPGHQEGHRRSISNMAPVGAPRQHHHK

SEQ ID NO: 28493 - protein, 548 aa, Marchantia polymorpha
MGNCVGGHSDRKNALNPNEPAATNVQRGTGAPQGSHGGSGAAGVSAQASHPAPLGGISAKQKPTLTGNVLGRPLEDVRSIYTLGRELGRGQFGVTHLCTHKVTGELLACKSIAKRKLTNKDDVEDVRREVQIMHHLEGQKNIVELKGAYEDKHNVHLVMELCAGGELFDRIIQRGHYSERAAAALCRTIVQVVQTCHSLGVMHRDLKPENFLLANKKEDAPLKATDFGLSVFFKPGEVFTDIVGSAYYVAPEVLRRNYGPEADVWSAGVILYILLCGVPPFWAETEQGIFDAVMHGHIDFTSDPWPSISQKAKDLVKRMLKQNPKERLTAHEVLSHPWISVDGEAPDKPLDNAVLSRLKQFTAMNKLKKLALKVIAESLSEEEIMGLKEMFKSMDTDNSGTITFEELKDGLQKQGSNLAESEVRQLMAAADVDGNGTIDYLEFITATMHLNKIEKEDHLYAAFQHFDEDSSGFITMEELEQALIKHGMGDPDTLKEIIREVDTDHDGRINYDEFVAMMRKGTPGHQEGHRRSISNMAPVGAPRQHHHK

SEQ ID NO: 28494 - protein, 200 aa, Vibrio harveyi
DPRETVTAQQADLHLPIKNDGDVSLFNGLLKFLIEQQCIDSEYIHSYTDGFDALTEEVSDLRYDVTNLTSSIGISEEKLTTFFQWFAQSSTAITLFCQGVNQAENGVDKGNAIINAHLASGKIAKSGCGPFSITGQPNAMGGREVGGLANQLAVHRAFDAGSIKQVQAFWDSPEIATQPGLKAVDLFEAVERSEIKVLWI

SEQ ID NO: 28495 - protein, 284 aa, Triticum aestivum
MVYGGEEALRRQYSIGDEIGHGRFGTVRRCHSNATGEALALKTTPKAPLRDPLDLALAEQEPKLHLLASSPPCSPHLVALHAAFDDADAVHLVVDLCAGGDLLSLLSARGGRLPEREAAGLAAQIASALAACHRRGVAHRDVKPDNLLFDAATGALKLADFGSPRGRGDGRRMSGIVGTPYYVAPEVVAGREYGEKVDVWSAGVVLYMTLSGSVPFYGATAPEIFEAVLRGNVRFPPRAFAGVSPEAKDLMRRMLCKDVSRRFSAEQVLRHPWIASCGGNAVAG

SEQ ID NO: 28496 - protein, 402 aa, Bacteroides thetaiotaomicron
MEKNIFKLDNEQLKAIVCSFRDKTEEGLKTENAEIQCIPTFIAPKTTHIKGKSLVLDLGGTNYRVAIVDFDKATPTVHPNNGWKKDMSIMKSVGYTREELFKELADMIIGIKREEEMPIGYCFSYPAESVPGGDAKLLRWTKGVDIKEMVGEFIGKPLLDYLNERNKIKFTGIKVVNDTIASLFAGLTDNSYDAYIGLIVGTGTNMATFIPADKIEKLDQSCNAHGLIPVNLESGNFHPPFLTAVDDTVDAISGNPGKQRFEKAVSGMYLGDILKTAFPLEEFEEKFDAQKLTSIMNYPDIYKDVYVQVAQWIYGRSAQLVAASLTGLIMLLKSYNKDIRKVCLVAEGSLFWSENRKDKNYNILVMEKLRELLQLFGLEDIEVDIKSMNNANLIGTGIAALS

SEQ ID NO: 28497 - protein, 454 aa, Novosphingobium aromaticivorans
MSDPVIVWFRRDLRLADQAALLAAAAEGPVIPVYILDDDTPRHCRMGGASRWWLHHSLAELDASLRKLGSRLILRRGKCHEELAAVRREAGARVVHALQHYEPWWRNAEKAVAKTIRLVLHEGNYLAPAGSVRTGMGRPYKIYTPFWHALLERMPPAPPLPAPERLEAPAVWPTSDALDDWKLLPTAPDWAGGFRETWTPGENGAEERLQDFADRVARYGETRNLPSIEGTSRLSPHLHFGEISPATIWHRVVNAGGSVDVFLGELGWRDYAQNVIVQFPDYGSRNAREAYDRLEWRDDPEALRAWQQGRTGYPIVDAGMRELWHTGWMHNRVRMIAASFLVKHLLIDWREGERWFWDTLVDADYASNAVNWQWTAGTGVDSNMFVRIMAPLTQSPKFDAAGYIRQWVPELAHLSDRDIHDPAVPPRGYPAKIVSHSEARARALAAHDRMKQPA

SEQ ID NO: 28498 - protein, 98 aa, Glycine max
  misc_feature (21)..(21): Xaa can be any naturally occurring amino acid
  misc_feature (41)..(41): Xaa can be any naturally occurring amino acid
  misc_feature (76)..(76): Xaa can be any naturally occurring amino acid
  misc_feature (84)..(84): Xaa can be any naturally occurring amino acid
QLPNHTVHTGSDCGAIAHLHXEHGQNFLDMLDGISLFVLLXDTRDPSSIVALDAIYGTFLYIDWGIDGSYWISSEXKGLNDRLXHIAPFTPCHSYSSI

SEQ ID NO: 28499 - protein, 436 aa, Unknown
  Candidatus Pelagibacter ubique HTCC1002
MSSEKNYLNENYKSFFEDSLSVTDPELHKAISDELKRQQQHIELIASENIVSQAVLEAQGSVLTNKYAEGYPGKRYYNGCEHVDVAENLAIERLKKIFDCKFANAQPHSGAQANGAVFLALLNPGDTFMGMSLNSGGHITHGLKISMSGKWFNPIGYDVDKESELIDYDNVEKLALEHKPKLIICGGSAYSRVIDFKRFREIADKVGAYLMVDMAHFSGLVAGKGYPNPCEHAHVVTSTTHKVFRSARGGIILTNYEDLAKKFNTAVFPGYQGGPLMHVIAGKAAGFLEALRPDFKDYIKSVLANAKILSETLKNNGFKIYSGGTDTHLMLVDLRPFNVKGNAAAESLSNANITCNKNGIPFDSEKPMITSGIRLGTQAATTRGFGLKEFEKVGELITKVVKGLSKNPEDNSKIEEEVRNEVIDLTSNFPIYKNLK

SEQ ID NO: 28500 - protein, 826 aa, Bacteroides thetaiotaomicron
MKIIIIGGVAGGATTAARIRRTNEAAEIILLEKGKYISYANCGLPYYIGGVIKEREKLFVQTPEAFSTRFRVDVRTENEVIFIDRKRKTVTVRQSSGDTYEESYDKLLISTGASPVRPPLPGIDLNGIFTLRNVADTDRIKEYINSHAPRKAVVIGAGFIGLEMAENLHAQGAKVSIVEMGNQVMAPIDFSMASLVHQHLMDKGVNLYLEQAVASFERDGKGLKVIFKNGQSISADIVILSIGVRPETTLARAAELKIGEAGGIAVNDYLQTSDESIYAIGDAIEFRHPITGKPWLNYLAGPANRQGRIVADNIQGAHIPYEGAIGTSIAKVFDMTVASTGLPGKRLRQAEINYMSSTIHPSSHAGYYPDAMPMSIKITFDPKTGKLYGGQIVGYDGVDKRIDEIALVIKHEGTIYDLMKVEQAYAPPFSSAKDPVAVAGYVAENIITGKVQPVYWRQLRDIEMENNFLLDVRTPDEFSLNTLPGAVNIPLDELRDRLDELPKDKMIYTFCAVGLRGYLAYRILVQHGFEKVRNLSGGLKTYHAAAAPIILREESENEVPAQPNANIQQPADAQPQKTVSPVEAVKTIRVDACGLQCPGPILKMKKTMDSLVSGDRVEITSTDPGFPRDAAAWCNSTGNQLISKETAGGKSVVVIEKGEPKSCNIVTSCEGKGKTFIMFSDDLDKALATFVLANGAAATGQKVTIFFTFWGLNVIKKLHKPNVEKDIFGKMFGMMLPSSSRKLKLSKMSMGGIGGKMMRYIMNRKGIDSLESLRQQALENGVEFIACQMSMDVMGVKQEELLDEVTIGGVATYMERADNANINLFI

SEQ ID NO: 28501 - protein, 256 aa, Chlamydomonas moewusii
MAFALISNRALTVKVEAAKKAAGTKQTKAAPAKSAGIEWYGPDRAKWLGPFSTNTPAYLTGEFPGDYGWDTAGLSADPETFKKYRELEVIHARWALLGALGILTPELLSTYAGVKFGEPVWFKAGAQIFSEGGLDYLGSPALIHAQNIVATLAVQVVLMGLIEGYRVNGGPAGEGLDPLYPGESFDPLGLADDPDTFAELKVKEIKNGRLAMFSCFGFFVQAIVTGKGPIQNLADHLADPGTNNAFAAATKFTPSA

SEQ ID NO: 28502 - protein, 113 aa, Geobacter sulfurreducens
MKEIKAIIRPAKLLEVTEELHAIDGLPGVTVSEIKGFGKSRAKNAQDKIVYEMVELVPRIQLEVVVDDGMVEEVVAVIRKHAHTGTAGDGKIFVSTVDDIIKIRTNERGRDAI

SEQ ID NO: 28503 - protein, 471 aa, Legionella pneumophila
MTIALVWFRQDLRLTDNPAFIEACSHHEIVIPLYIYDDKCSVLGQAQAWWLHHSLIALGKSLNQQGLCLVLRKGAPQEIILELVAQYGVESVYWNRCYEPQAIARDKKIKLALGEREIKVQSFNGNLLHEPWTIKNKNGDFFKVFTPYWKQCRQILNIPSPFMLTKRPRGIKITSDDLGKWKLLPAINWAARFSEYWTPGEEGAQKKLDEFIVHHLSGYKRERDFPAKNATSRLSPHLHFGEISPWVILRALELAKLEQTCDLASVEHFLSELGWREFSVYLLYHFPKLDCENFRKEFDAFPWQNDEQLLTCWQKGMTGYPIIDAGMRELWATGYMHNRVRMIVASFLTKDLLIDWRSGAQWFLDTLVDADLANNSASWQWVAGCGADAAPYFRIFNPVLQSQKFDPDGVYIRQWIPELAQLNSQSIHQPWTDADASSIFLGKKYPKPIIDHQEARTKALSYYQQIKKGMD

SEQ ID NO: 28504 - protein, 537 aa, Herminiimonas arsenicoxydans
MTVKVAIAQINSTVGDLAGNRAKIAEFSRRAAEQGADIVLTPELSLVGYPPEDLLLRQSFYAKSAQALDALAADLAELKNLHVVVGHPFEKDGQRFNAASVLLNGKISATYCKHDLPNATVFDEKRYFSSCDQAVVFDVKGVRFGINICEDTWFPQAPARAAAAGAQVLLVPNGSPYHMNKQHVRIDVMHANVTTHGMSLVYANLVGAQDELIFDGNSFVLDQAGETRAQLQHCVEDLQIVEFRGGQPLDGTIVEEPSVEAQVYKALVLGVRDYIGKNGFPGALIGMSGGVDSALTLAVAVDALGADKVRTIMMPSPYTAEISLLDSRDMVQRVGVRYDEIGINDCFEAFNRTLANEFKGLPEDATEENIQARIRGTILMALSNKHGAIVLTTGNKSEMAVGYCTLYGDMAGGFAVLKDIAKTLVYRLCAYRNSVSDVIPERILTRAPSAELRPGQTDQDSLPPYDILDAIMQMYMEENQSGADIIAAGYRAEDVARITHLIKINEYKRRQSPVGIRVTHRAFGRDWRYPITSKFRE

SEQ ID NO: 28505 - protein, 112 aa, Herminiimonas arsenicoxydans
MKQITAIIKPFKLDEVREGLADVGVTGLTVTEVKGFGRQKGHTELYRGAEYVVDFLPKVKVEAVVDDAVVEQAVDAIIKAARTGKIGDGKIFVQAVEQVVRIRTGETGIDAV

SEQ ID NO: 28506 - protein, 382 aa, Triticum aestivum
  misc_feature (305)..(305): Xaa can be any naturally occurring amino acid
  misc_feature (310)..(310): Xaa can be any naturally occurring amino acid
  misc_feature (317)..(317): Xaa can be any naturally occurring amino acid
HYRTSLYKKAGWYRSGIPGISSTHASGVAGLACAHAAAGAGWKAVVLEKAAGPAAGGGTGAGLGLDAQSMETLARWIPGWGLDAATLPLAVDLNMATDSETKAARTLTRDEGFNFRAAHWGELHRRLHEAPPAAVTVHWGHQFLSFEVSDTDGDGGKRGGVVATARVLRTGETVEVAGDLLVAADGCTSSIRRRFLPDLKLRYSGYCAWRGVFDFTGKESSDIITGIRRAYPELGSCLYFDLAEKTHAVLYELPGNRLNWLWYINGPEPELTGSSVTMKVSDATLAGMQEDAERVWSPELARLIXETAEXFVNVIYXGPLAGLSWRGARGMVGNRAPDSRRAGDTTVRHYPGFRECREGGEPPPPPEQISPRFRSWGLVSPP

SEQ ID NO: 28507 - protein, 413 aa, Burkholderia mallei
MSTADPYLIAGGGHAARRAAETLRERDPAARIVMIGAEPELPYDRPVLSKEALVGGDAGERRAFVRDAAWYRERDIELRLGVRVEAIERGARRVRLSDGARLGYARLLIATGSRVRRFAGPVDAGVHVHYVRTLADTRALRAALAPGKRVAVLGGGFIGLEVAASAVRLGCRATVVDPAPRLLQRRMPEAVGAFALALHARHGVDVRLGALPERIRRAANGAAVVETSAGGIVADVVVAGIGVVPNVELAQAAGLDVDDGVCVDEMCRTADPAIFAAGEVTRHFNPLVGRALRIESWQIAENQPAVAAANMLGAAETYAQWPWLWSDQYDSNLQTLGLFGGEQTLVLRGSPERDRAFCVFALNARRELAAVAAVNAGREIAVCRRLMTAGVALDPARLADPSDALRAMLPRGV

SEQ ID NO: 28508 - protein, 302 aa, Pseudomonas aeruginosa
MDKDKVLLVLHGKQAGNEEVRAAVAAQREAGRELAVRVTWEDGDARRIVEEALAAGFATLVAGGGDGTLREVAEALARGRGEASLAILPLGTANDFARAAGIPLEPAAALALLDQTARPIDLGAVNGKLFLNMATGGFGSKVTANTSEDLKKVLGGAAYLLTGLTRFSEVHAAQGRFSAPDFQWEGEFLALGIGNGRQAGGGHVLCPQARVDDGLLDVSILPTPQDMVGTLGTLLGGGNGVESLFVRARVPWLEVEAAEGLDVNLDGEPLEGRKLRFSVSPGALRVHLPAGSPLLREPPRED

SEQ ID NO: 28509 - protein, 317 aa, Herminiimonas arsenicoxydans
MPSPKHAHVLILGSGPAGYSAAVYAARANLKPVLITGVEQGGQLMTTTDVENWPGDPLGVQGPELMQRLLQHAERFNTEIIFDHIHTTKLDEKPIRLIGDMGEYTCDSLIIATGASAQYLGLPSEQAYMGKGVSACATCDGFFYREQEVAVIGGGNTAVEEALYLSNIATKVTLVHRRDKFRAEAILIDRLMAKVAEGKIEIKYNHTLDEITGDDSGVTGINIRSTTDDSITAIKLHGVFIAIGHKPNTSIFEGQLDMHNGYIKTKTGLEGMATSTSVPGVFAAGDVQDHIYRQAVTSAGTGCMAALDAQRYLESQE

SEQ ID NO: 28510 - protein, 858 aa, Gluconobacter oxydans
MMVTGLAAVLLALAFLLTLVSIIQPLAKRLEISEAVLLALTGIGLGLVASLIVRSSATDLLDGAAEALIYFPVNSEAFLLIFLPILVFQGAMAIDVRRLAHETATVLLLAVVAVIVSTATIGFALYPFAQQSLVVCLLLGSIVATTDPSAVAGIFREIGAASRLTRLVEGEALLNDAAAISIFSILLAAVTSHHQIHLADALMDFLTAFIGAIVVGVCLARLTLLLIAGLGGSAASEVTLTLALPYAVYILCDEMLGFSGVVATAAAGLTVSAYGPSTFRPQVWRFLNEMWEQLVFWAGSLVFLLAAMLVPRLLIGMTKWDFVLILIASVAGLIARSAVIFGMLPLLAITKLSPPVPNPFKATMAWGGIRGAITLALALAVTENQSVSSPVAHFVGIIATGFVLITLLVNGTTLRALVLFFKLDQLSPIDQAIRQQIVGIGLGEVAERTRELSEELGFSEQTRAGVISRLERRAEKERAANNFESALSDRNRVDIALITIANQERSLLLDLFRIQGLSRRVMETLLRTTESMADGARLEGRYGYVRALKRRLQPSLRFRIAQELHSRLHIDEPLTNCMMERFEMLIIAHLVSLSLQRFIRQRMEPTLGPRITEIVSEVLGRQRKLLDDALETLRLHYSGYSEALESRILRQIALRLEDEEYDALEADNLISEELHRELHREIERQRARLDAPLRFNLKSGIEQRLRAFPAFNGVPDSVLQKLSRKVSMHFVSPGEILFKRGQRVRVVYAQVAGLAEVNLAERDLLFGSGDLIGAASVIRNETMPGTVRSLQFSHLLAIPRPVFEKLLKEYPIVQRLIIQRSQKRADGLLTPVTVRTLDGDVVSTASAPEMRRLVAPPS

SEQ ID NO: 28511 - protein, 501 aa, Glycine max
GDSRRKYATGSMPTSNFQITYGFTECTPDLSLQECTQCLGEAIADIPVYFNGKTGGNVLKPSCRIRFDPYSFYGSTLKLDPDAPPPATPLPSPPTNNNSSSQGKSNTSRIIIAIVVPVASVVLVLILFCIYLRVKKPRKENEIKREEDNYEDEITFAESLQFNFDTIRVATNEFADSYKLGQGGFGAVYRGQLSNGQEIAVKRLSRNSGQGDMEFKNEVLLVAKLQHRNLVRLLGFCLEGTERLLVYEFVPNKSLDYFIFDPIKKAQLNWQRRYKIIGGIARGILYLHEDSRLRIIHRDLKASNILLDEEMHPKISDFGMARLVHMDQTQGNTSRIVGTYGYMAPEYALYGQFSAKSDVFSFGVLVLEIISGQKNSGVRHGENVEDLLCFAWRNWRAGTASNIVDPTLNDGSQNEIMRCIHIGLLCVQENVVARPTMASIGLMLNSYSLTLPVPSEPALLVDSRTRSLSEHDSMETRTSESANQSTPKSINEVSITELYPR

SEQ ID NO: 28512 - protein, 260 aa, Anabaena variabilis
MNRTDNEGQKSLGKVYLVGAGPGDPGLMTVKGKGILECADVVIYDALVSPAILAMINPQAEQINAGKRMGRHSLLQDETTQLLIEQAQNHAVVVRLKGGDPFIFGRGGEEMADLIAAGVPVEVVPGITSGIAAPAYAGIPLTHRLYSSSVTFVTGHESAGKYRPKVNWQAIAQGSETIVIYMGIHNLPYIVEQLKTAGLSLATPIALVRWGTRPEQEELIGELGTIIELVEKTGFEAPAIAVIGSVVNMHSILSVAGRVH

SEQ ID NO: 28513 - protein, 295 aa, Methylococcus capsulatus
MFPTIESFVGNTPLVRLQRLPGDTANFILAKLEGNNPAGSVKDRPALSMIRCAEARGDIQPGDRLIEATSGNTGIALAMAAAIKGYRMTLIMPDNMSAERRATMKAFGAEIILTPAAGGMEAAIDLARAMEARGEGKILDQFSNSDNPRAHYEGTGPEIWRDSQGRVTHFVSSMGTTGTIMGTARYLKERNPAIQIIGVQPKDEARIPGIRRWPQEYLPKIYDPSLVDRILDVTQEEAESTTRELAAQEGIFAGISSGGAVAAALRLSREVENAVIAVIICDRGDRYLSTGVFPE

SEQ ID NO: 28514 - protein, 86 aa, Glycine max
MPRFELCSMLRFCVIVRYIRRGTPDAGFALFESESLKWPGFVEFDDVNGKVLTYSAQDSIYKVFDLKNYTMLYSISDKNVQEIKIR

SEQ ID NO: 28515 - protein, 132 aa, Zea mays
MSNPGSSPAFLVPAKRITSPDDIARFHASVHGLHFLGFVAALSASVHGRKLSDPLPSPPSPAIAAVLDLVSALAALVASTPPLPHSSRYGNPAFRLWHEKLTDSASELISRITATASSPADLAGARCRASTV

SEQ ID NO: 28516 - protein, 561 aa, Candida albicans
MINLLTSNITTGETHLLIGYSAVSNTRIVSIIESGANPILITDSQPQNFPPNIMQYVTDNKLPVLIDKDFPTKIPHYLTTLGRAEVDSIVDRVYVSLPSSQLALKQEIYQRCRKLRIPVNTTDSPDLCTFTMLSTYTSGDFQLGVTTNGKGCKLASRIKRELVNSLPSDIDAICKQVGELRRQIQMEDKAESEHGEHEDDAINNHKFNSFVPEFNKTQEDLKLQRARWLSQIVEYYPLNKLGSISLKDLSSAYKLHKQANVPGAKEEDSEAGQMTLVGSGPGSVSLLTLGALQAIQTADLVLADKLVPQQVLDVIPTTHHTRLFIARKFPGNAEKAQEELLTLGLEALRRGEKVVRLKQGDPYIFGRGGEEFNFFSQHGFKPTVVPGITSALAAPVLSNIPMTHRDVADQVLICTGTGRRGAVPNLPDFVSSRTTVFLMALHRVVELIPLLVNDKKWDENLPVAIVERASCPDQRVIRTTLSKVGDAVEACGSRPPGLLVTGYACEVICKNSGSESLPWVVEEGCNSGDDGELKRIVELVNGNCKESTAVVSPNLQKEIAA

SEQ ID NO: 28517 - protein, 72 aa, Listeria innocua
MAKEDVIEVEGVVQETLPNAMFNVELENGHKVLATVSGKIRMHYIRILPGDKVTVELSPYDLTRGRITYRFK

SEQ ID NO: 28518 - protein, 112 aa, Mannheimia succiniciproducens
MKKIEAIIKPFKLDDVRESLSDIGITGMTVTEVRGFGRQKGHTELYRGAEYMVDFLPKVKLEIIIPDELLDQCIEAIMETAQTGKIGDGKIFVYNVERVIRIRTGEENEDAL

SEQ ID NO: 28519 - protein, 573 aa, Trichoderma atroviride
MSKEESGHVTPEKGDNVVDYQASTTVLPSEGPERDANWFTRNGLNVDSFKKKHYGPGMVELERPMKARHLHMIAIGGSIGAGFFVGSGGALAKGGPGSLFVDFLIIGIMMFNVVYALGELAIMYPVSGSFYTYSARFIDPAWGFAMGWNYVLQWAAVLPLELTVCGITISYWNSEITTAAWISLFLGVIIIINLFGALGYAEEEFWASCFKLAATVIFMIIAFVLVLGGGPKDGRYHEYWGARYWYDPGAFKNGFKGFCSVFVTAAFSFSGTELVGLAAAESTNPTKNMPGAIKQVFWRITIFYILGLFFVGLLINSDDPALLSSAAYADSKASPFVLVGKYAGLKGFDHFMNLVILASVLSIGVSGVYGGSRTLTALAQQGYAPKLFTYIDKSGRPLPSVIFLILFGFIAYVSLDATGPVVFDWLLAISGLAALFTWGSVCLAHIRFRKAWKYHGHTLDEIPFKAAGGVYGSYLGLFICVIVLMAQFYTAIAAPPGSPGVGTAEDFFKQYLAAPVVLGFWIVGWLWKRQPFLRTKNIDVDTGLREFDWDEINAERTRIAPLPAWRRIIHHTF

SEQ ID NO: 28520 - protein, 335 aa, Unknown
  Oceanospirillum sp. MED92
MYEIPGFTDEHHIPSAIAVLTSGGDSPGMNPAIRGVVRAALHRGIKVFGINKGYSGLIIGDLEEMNSASVTNIVQRGGTILKSDRCEAFKDPAVRHQAAEVLKEKGIDTLVVIGGDGSLTGAHYLTLENDIRVIGLPGTIDNDIYGTDDTIGFDTAVNTALEAIDKIRDTALSHESLFLVEVMGRNSGFIATHVGIACGAEMIVIPEYEVKVDAISSQLASNREQGKGSSGIIVVAEGPKPGLTYDLAKQLKNHGQQPKVCILGHIQRGGIPSGHDRILASCLGASAVDYLCAGYNDIMIGVRRGKIVDTPLAQVIEKSKELDEALFQRALLLHK

SEQ ID NO: 28521 - protein, 327 aa, Unknown
  Thermotoga sp. RQ2
MAVPLCESWSLCCIYSACSDRKGMNMVFLIYNPAAGGGRAGKIWDRVEDLLKKHGIDHKVAFTERPGRAMEISKKAFKEGYRRIAAFGGDGTVNEVVNGIFLNGYDLREVVFGWIPFGSGKDWARTIGVPLEIEEAIKTLKDGKEFVQDLGVGEYEKASGEIEKRAFVNVAGLFFDGFVTYRTNLLKRKNRVSYFSRIFSSIIEYDPPTARIQIDEKVWEKRVFSMNVGICKYNGGGMNQLPHAVPDDGLLAVTVINDIGKLRILANLHRVFNGKLLEHPGVEGYQAKKVVVEFQRDEPVEFDGESFWAKKIFFSIIPGVIRVLVKK

SEQ ID NO: 28522 - protein, 443 aa, Salmonella enterica
IGVVGMAVMGRNLALNIESHGYTVSVFNRSREKTEEVIAENPGKKLVPYYTVKEFVESLETPRRILLMVKAGAGTDAAIDSLKPYLEKGDIIIDGGNTFFQDTIRRNRELSAEGFNFIGTGVSGGEEGALKGPSIMPGGQKDAYELVAPILTKIAAVAEDGEPCVTYIGADGAGHYVKMVHNGIEYGDMQLIAEAYSLLKGGLNLSNEELANTFPEWNNGELSSYLIDITKDIFTKKDEDGNYLVDVILDEAANKGTGKWTSQSALDLGEPLSLITESVFARYISSLKAKRVAASKVLSGPKAQPASDKAEFIEKVRRALYLGKIVSYAQGFSQLPAASDEYHWDLNYGEIAKIFRAGCIIRAEFLQKITDAYAENAGIANLLLAPYFKKIADEYQQALRDVVAYAVQNGIPVPTFSAAVAYYDSYRAAVLPANLIQAQRDYF

SEQ ID NO: 28523 - protein, 297 aa, Campylobacter jejuni
MRIAVIGAGKWGSALHLALKENHNCFISSLHQRDLEDFVSIKEALECEYLVFALSSQGMRAWLKENFINKGQKILIASKGIEDQSCQFLDEIFLDFVPKENFCVLSGPSFAAEVMQKLPTALMISGINQELCKKFASFFPDFIKTYIDNDVRGAEICGAYKNVLAIASGISDGLKLGNNARAALISRGLIEMHRFGKFFGTKEETFLGLSGAGDLFLTATSVLSRNYRVGLKLAQNQKLDSILAELNEVAEGVKTAYAIEKLAKMKGIYTPIVNEVVAIFKGKSVQEATQNLLKQND

SEQ ID NO: 28524 - protein, 443 aa, Salmonella enterica
IGVVGMAVMGRNLALNIESRGYTVSVFNRSREKTEEVIAENPGKKLVPYYTVKEFVESLETPRRILLMVKAGAGTDAAIDSLKPYLEKGDIIIDGGNTFFQDTIRRNRELSAEGFNFIGTGVSGGEEGALKGPSIMPGGQKDAYELVAPILTKIAAVAEDGEPCVTYIGADGAGHYVKMVHNGIEYGDMQLIAEAYSLLKGGLNLSNEELANTFTEWNNGELSSYLIDITKDIFTKKDEDGNYLVDVILDEAANKGTGKWTSQSALDLGEPLSLITESVFARYISSLKAQRVAASKVLSGPKAQPAGDKAEFIEKVRRALYLGKIVSYAQGFSQLRAASDEYHWDLNYGEIAKIFRAGCIIRAQFLQKITDAYAENAGIANLLLAPYFKKIADEYQQALRDVVAYAVQNGIPVPTFSAAVAYYDSYRAAVLPANLIQAQRDYF

SEQ ID NO: 28525 - protein, 443 aa, Salmonella enterica
IGVVGMAVMGRNLALNIESRGYTVSVFNRSREKTEEVIAENPGKKLVPYYTVKEFVESLETPRRILLMVKAGAGTDAAIDSLKPYLEKGDIIIDGGNTFFQDTIRRNRELSAEGFNFIGTGVSGGEEGALKGPSIMPGGQKDAYELVAPILTKIAAVAEDGEPCVTYIGADGAGHYVKMVHNGIEYGDMQLIAEAYSLLKGGLNLSNEELASTFTEWNNGELSSYLIDITKDIFTKKDEDGNYLVDVILDEAANKGTGKWTSQSALDLGEPLSLITESVFARYISSLKAQRVAASKVLSGPKAQPAGDKAEFIEKVRRALYLGKIVSYAQGFSQLRAASDEYHWDLNYGEIAKIFRAGCIIRAQFLQKITDAYAENAGIANLLLAPYFKEIAYEYQQALRDVVAYAVQNGIPVPTFSAAVAYYDSYRAAVLPANLIQAQRDYF

SEQ ID NO: 28526 - protein, 443 aa, Salmonella enterica
IGVVGMAVMGRNLALNIESRGYTVSILNRSREKTEEVIAENPGKKLVPYYTVKEFVESLETSRRILLMVKAGAGTDAAIDSFKPYLEKGDIIIDGGNTFFQDTIRRNRELSAEGFNFIGTGVSGGEEGALKGPSIMPGGQKDAYELVAPILTKIAAVAEDGEPCVTYIGADGAGHYVKMVHNGIEYGDMQLIAEAYSLLKGGLNLSNEELASTFTEWNNGELSSYLIDITKDIFTKKDEDGNYLVDVILDEAANKGTGKWTSQSALDLGEPLSLITESVFARYISSLKAQRVAASKVLSGPKKQPAGDKAEFIEKVRRALYLGKIVSYAQGFSQLRAASDEYHWDLNYGEIAKIFRAGCINRAQFLQKITDAYAENAGIANLLLAPYFKKIADEYQQALRDVVAYAVQNGIPVPTFSAAVAYYDSYRAAVLPANLIQAQRDYF

SEQ ID NO: 28527 - protein, 306 aa, Unknown
  Sulfitobacter sp. EE-36
MMDLNLSPAGAGDADLIKDTSEATFMADVVEASQTVPVIVDFWAPWCGPCKTLGPMLEDAVRAAKGAVKMVKINVDEAQQIAGQLQIQSIPTVYAFFKGQPVDGFQGALPQSEIKAFIDRVIKAGGGEAPGEELSEAVAAADDMLAEGATQDALDTFAAILGEDPNHAGAYCGMVRAYIALDQLDQAEAHLNGAPIEISKAPELEAAHAQLQLARQAADAGPVAELQAAVDANPDDMQARFDLAQALYAHGDTQAAVDQLLTLFGKDREWNDGAAKTQLFIIFEALKPNDPIALNGRRKLSSMIFA

SEQ ID NO: 28528 - protein, 154 aa, Streptococcus pyogenes
RPPSDSARILSVRSGYTGGHLPNPSYEQVCAKTTGHTEAVEIIFDPKQIAYKDLVELYWAQTDPTDAFGQFEDRGDNYRPVIYYTTERQKEIAEQSKANLQASGRFDQPIVTTIEPAEPFYLAEDYHQGFYKKNPKRYAQSSAIRHQFLEENWS

SEQ ID NO: 28529 - protein, 282 aa, Glycine max
MYREAAVKKEEYQVLEELGRGRFGTVFRCFHRTSNKFYAAKLIEKRRLLNEDRRCIEMEAKAMSFLSPHPNILQIMDAFEDADSCSIVLELCQPHTLLDRIAAQGPLTEPHAASLLKQLLEAVAHCHAQGLAHRDIKPENILFDEGNKLKLSDFGSAEWLGEGSSMSGVVGTPYYVAPEVIMGREYDEKVDVWSSGVILYAMLAGFPPFYGESAPEIFESVLRANLRFPSLIFSSVSAPAKDLLRKMISRDPSNRISAHQALRHPWILTGALTTATISNFLT

SEQ ID NO: 28530 - protein, 443 aa, Salmonella enterica
IGVVGMAVMGRNLALNIESRGYTVSVFNRSREKTEEVIAENPGKKLVPYYTVKEFVESLETPRRILLMVKAGAGTDATIDSLKPYLEKGGIIIDGGNTFFQDTIRRNRELSAEGFNFIGTGVSGGEEGALKGPSIMPGGQKDAYELVAPILTKIAAVAEDGEPCVTYIGADGAGHYVKMVHNGIEYGDMQLIAEAYFLLKGGLNLSNEELASTFTEWNNGELSSYLIDITKDIFTKKDEDGNYLVDVILDEAANKGTGKWTSQSALDLGEPLSLITESVFARYISSLKAKRVAASKVLFGPKAQPVGDKAEFIEKVRRALYLGKIVSYAQGFSQLRAASEEYHWDLNYGEIAKIFRTGCIIRAQFLQKITDAYAENAGIANLLLAPYFRKIADEYQQALRDVVAYAVQNGIPVPTFSAAVAYYDSYRAAVLPANLIQAQRDYF

SEQ ID NO: 28531 - protein, 268 aa, Unknown
  Malus x domestica
MYIPRLSVSICLHPLLIYKIAKPSKLNPISSTLIVTAGFTMLKHAAKSKVSSSTCDRRVKYLGPFSGEWPSYLTGEFPGDYGWDTAGLSAYPETFAKNRELEVIHSRCAMSAALGCIFPELLSVMGQGFGEAVWFKAGAQIFSEGGLDYLGNPSLVHAQSILAIWTTKVILMGAVEGYRIARGPLGEVTDPLYPGSFDSLGLAEDTEAFAELKVKELKNGRLAMFSMFGFFVQAIVSRKDRLENLADHLGWTVNNNALSNVTNFVPGN

SEQ ID NO: 28532 - protein, 162 aa, Novosphingobium aromaticivorans
MSGPRTIADFKARKPNGEEIDLAEKKGKVLLVVNTASKCGFTPQYDGLEALWRQYGERGFEVLAFPCNQFGKQEPGTADEIESFCKVNFGLSFPLMAKIEVNGDNADPLYDWLKSEAPGVLGTKSIKWNFTKFLIDREGRVVRRYAPTDKPESIAGDIERLL

SEQ ID NO: 28533 - protein, 318 aa, Ralstonia solanacearum
MAKHAKVLILGSGPAGYTAAIYAARANLNPMLITGLAQGGQLMTTTEVENWPADREGLQGPELMQRFLEHAERFSTDVVFDHIHTAHLTEKPIRLVGDSGEYTCDALIISTGASAQYLGLPSEETFSGRGVSACATCDGFFYKGQEVAVVGGGNTAVEEALYLANIASKVTLIHRRDKFRAEPILVDRLLEQQKKGKIEIKYNTVLDEVLGDDSGVTGVRLRGVNGNATGAEEVRLAGVFIAIGHKPNTDLFKGQLDMNETGYLRTQSGLVGNATATNIPGVFAAGDVQDHIYRQAITSAGTGCMAALDAQRYLENQE

SEQ ID NO: 28534 - protein, 269 aa, Physcomitrella patens
MAAATAMHSTALAGQSLVKPVNELSRKVLGNVEARVTMRRTVSKSAGSDTIWYGADRPKFLGPFSGETPSYLNGEFAGDYGWDTAGLSSDPETFARNRELEVIHARWAMLGALGCLTPELLAKSGVKFGEAVWFKAGAQIFSEGGLDYLGNPSLVHAQSILAIWACQVVLMGAVEGYRVAGGPLGEVTDPIYPGGSFDPLGLADDPDTFAELKVKEIKNGRLAMFSMFGFFVQAIVTGKGPLENLNDHLADPVANNAWAYAPTSPPGTR

SEQ ID NO: 28535 - protein, 696 aa, Solibacter usitatus
MTSNLLENPQSAPPCTAALAGRCSPLGATVQANGVNFSVFSRSASAIELLLFDREDDALPARVIRIPAATNRTYHYWHTFVPGARPGQLYGYRVHGPFDPASGLRFDPRKLLLDPYGRGIVVPAGYSREAARLPGDSARTAMKSVVIDPAAYDWEGDTPLHRPSSRTIIYELHVRGFTRHPSSGLSENLRGTYAGLIEKIPYLHDLGITAVELMPVFQFDPQDAPVGHCNYWGYAPVSFFAPHQQYSSRRDPQGVLNEFRDMVKALHRAGIEVILDVVFNHTAEGDHRGPTLSFRGFDNTAYYLLEPDRSYSNYSGTGNTLNANHPIVRRMIVDSLRYWVEEMHIDGFRFDLASILSRDCCGRPMAQPPVLWDIECDAVLAGTKLIAEAWDAAGLYQVGSFIGDSWREWNGRFRDDIRAFVRGDDDTAARFADRWLGSQEIYGHENREAEQSINFVTCHDGFTLNDLVSYNDKHNQQNGESNRDGCNDNRSWNCGVEGPSNDPEIEALRNRQIKNFLTITLLSLGVPMIVMGDEVRRTQQGNNNAYSQDNETSWFDWTLVQRHADLHRFVKLLIARRLLRDIDSDRTTLNELLHGARKAWHGVTLFEPDWSPWSHSLALGAELFKERLEFHMIFNSWWQPLDFELPPVLSRSPWRRWIDTAQPSPRDIVDWQAASPIDGLHYHAAPRSVVVLIRDR

SEQ ID NO: 28536 - protein, 256 aa, Solanum lycopersicum
MATTSAAVLNGLSSSFLTGGNKSQALLAAPLAARVGGAATPKRFTVLAAAAKKSWIPAVRGGGNLVDPEWLDGSLPGDYGFDPLGLGKDPAFLKWYREAELIHGRWAMAAVLGIFVGQAWSGIPWFEAGADPGAIAPFSFGTLLGTQLILMGWVESKRWVDFFDPDSQSVEWATPWSKTAENFANFTGEQGYPGGKFFDPLALAGTLNNGVYVPDTEKLERLKVAEIKHARLAMLAMLIFYFEAGQGKTPLGALGL

SEQ ID NO: 28537 - protein, 318 aa, Mycoplasma hyopneumoniae
MEKLVTQQVQNVDPKQSEILNISEIPAENPTETPIISKQKLLEAGVYFGHKASQWHPKMAQFLLKKKRNETHIIDVLKTQKMLEIAYKLVEKFAQKGAKFIFVGTKKQAKKVIEEQAVRTNSIYVSGRWLGGTLTNNRTILSRLKTMENLEKQAAENFQGYTKKEKLAKQKQLAKLQKNLNGIKGLKDVPLFSLIMLVADPLKDAIAVKEARKKGIKIIGITDSNVDPSLVDFGIPANDDSTKSITLIFTVLADAIASAKGGKKLFAYQSDENIILPEDPEKELKQTRYRSNSFEKFARQKNTLKDSQVLKPNTEIQA

SEQ ID NO: 28538 - protein, 300 aa, Burkholderia vietnamiensis
MAYKTIEDTIGNTPLVQLVRLPDDEIRARNNVVLAKLEGNNPAGSVKDRPALSMISKAEARGRIKPGDTLIEATSGNTGIALAMAAAIRGYKMVLVMPEDLSVERRQSMAAYGAEIILTPVKGGMELARDLAEQMQREGKGVILDQFGNPDNPVAHYESTGPEIWRDTEGRVTHFVSAMGTTGTIMGTSRYLKEQNPAIEIIGAQPEDGSRIPGIRKWPEAYMPTIFDRSRVDRVENVSQAASETMARRLAAVEGIFAGISSGGACEVAMRIARQVENATIVFIVCDRGDRYLSTGVFPA

SEQ ID NO: 28539 - protein, 256 aa, Solanum lycopersicum
MTTTSATAVLNGLSSSFLTGGKKTQALLGAHVTARVTTPKRFVVAAAAVAPKKSWIPAVKSGGNLVDPEWLDGSLPGDFGFDPLGLGKDPAFLKWYREAELIHGRWAMAAVLGIFVGQAWSGIPWFEAGADPGAIAPFSFGSLLGTQLLLMGWVESKRWVDFFDNDSQSIDWATPWSKTAENFANFTGEQGYPGGKFFDPLALAGTLNNGVYVPDTEKLERLKLAEIKHSRLAMLAMLIFYFEAGQGKTPLGALGL

SEQ ID NO: 28540 - protein, 112 aa, Ralstonia solanacearum
MKQITAIIKPFKLDEVRESLADVGVTGLTVTEVKGFGRQKGHTELYRGAEYVVDFLPKIKIEVVVADSQVDQVLDTIVKAAKTGKIGDGKIFVTAVEQVIRIRTGETNEAAV

SEQ ID NO: 28541 - protein, 313 aa, Pseudoalteromonas tunicata
MTIRTIPTLDISRFNSDKANFVAELGKGYREFGFCGIVGHGIDTELVAKAYDAIRTFFALPTDVKQQYSAANIGGARGYTGMGVEKAKDNPHPDLKEFWHVGRELAPEQLVEGLFPNVWPTEVPQFKADVYPLYQALDDLGRQVLSALALFLGQDEHYFDDKIDHGNSILRPLHYPPILQGETPAVRAGAHEDINFITLLVGSEEAGLEVLTRDGEYIPVTTIPGTIVVNIGDMLQRLTNNVLPSTTHRVVNPPGDGAKHSRFSVPFFLHPNPEFMIETLATCVTEDNPNRYPESISSNDYLTERLIEIGLIK

SEQ ID NO: 28542 - protein, 1096 aa, Tuber borchii
MDSRPSIANEDGPIVPNGNGTDPPMPQRKRIVVVGLGMVAIAFIEKILKLDAENKQYEIVVIGEESHVAYNRVGLTSFFEHRKVEDLYLNPKEWYESKPDVLNHKINTKVTSIDPVSKSITTSGGYDVSYDVLVLATGSDAVVPSNTPGHDSKGVFVYRNIEDLEKLISFSATVKGSTGCVVGGGLLGLEAAKAMMDLEQFGSVKLIDKNPWVLSRQLDQDAGKLVLEKITELGLDALSCRKIKTINSNENNQTESVTFEDGETMDTTCICFAIGIKPRDELADSAGIKTASRGGFIINKDVETTVPGIYAIGECASWENQTFGLIAPGVEMAEVLAFNLCKSALHGHSETPKAFRRPDLSTKLKLLGVNVASFGDFFADRDGPRELPGRSPSQERRGREVKALSYRDPFQAVYKKYIFTSDGKYLLGGMIIGDTADYIKLVGMVKSKKALEIPPSQLILGAKTEGEENPDDLDDDTQICSCHNVTKGDISKVVKDGSCKSLGDVKSCTKAGTGCAGCIPLVQSIFNAEMKAMGAEVSNHLCPHFAYSRVDLFNIIKVKEIKTFPEVMRECGKDPESLGCEVCKPTMASIFASLFNQHVMDKPMHMLQETNDKFLANIQRNGTFSVVPRVAGGEITPEKLIAIGTVAKKYNLYCKITGGQRIDMFGARKQDLVAIWTDLVEAGMESGHAYAKSLRTIKSCVGTTWCRFGVGDSVGMAIRLEERYKSIRAPHKIKSGVSGCIRECAEAQNKDFGLIATETGYNIFVGGNGGSKPRHSELLIKDCPVERVIPVLDRYLMFYIRTADRLQRTARWMENLPGGIKYLKEVILDDKLGICDQLEKEMQDLVKTYFCEWTEVVKDEERRKQFQQFANTSEASETIEIINERSQSRPTYWPKASVKYDFKNHRWSNLAWQPIIEASYFNNANSSTPVSAAVKRGDTQLAIFKVRGKYYATQQMCPHKRAFVLSDGLIGEDPDDGTEEGKKKKNMWVSCPYHKRNYTLEGKTPGGCANDEEVSIATFDVEERSDGWVYLKLPSVAELDSLLGTERWKVKKEESEDPFKEMDKKISNKGRKAAKPTEALNGNGSPIEKKINGLEW

SEQ ID NO: 28543 - protein, 546 aa, Ralstonia solanacearum
MTVLVALAQINCTVGDLAGNAARIVAAAREAHQAGARILVTPELSLTGYPPEDLLLRPAFLDAASRALDALVAELAAFAGLHVLIGHPQLLFEAPAPGSALPKPTNTATVAVDGRVLGQYHKLELPNNEVFDEKRYFQVGGEPFVFDVEGTRFGVILCEDAWYPKATAWAKAAGAQVVLIPNASPYHLDKEDLREQIIGARVQESGLPHVYVNLVGGQDELVFDGGSFVLDAHGKPAARMAQFVEGVGYVRFDGARPLPGEIAPEATLEAQVYAALKLGVRDYIGKNGFPGAIIGLSGGVDSALVLAIAVDALGADRVRAVMMPSRYTADISWLDARDMAARLGVRYDELPIMPMFDAFRGALAEEFRDLPEDATEENIQARIRGTLLMALSNKSGRIVLTTGNKSEMAVGYCTLYGDMAGGFAVIKDIFKTLVYRLCRYRNALSEVIPERILTRAPSAELRENQTDQDSLPEYDALDAIVQRYMEQNQPVAEIIAAGFAEADVQKIVRLIKINEYKRRQAPVGIRVTQRAFGRDWRYPITSRFKE

SEQ ID NO: 28544 - protein, 412 aa, Geobacter metallireducens
MYVTGNLAGNTIAMVLAGGKGERLAPLTLRRPKPGVAFGGKYKIIDFVLSNMFNSGIKKVYILTQYRAYSLMKHIRESWGKWAGLGEFFVAISPETSSESEEWFKGTADAINHYLRFIESSDADYVAIFGGDHIYRMDVSQMIGYHRRNRADITIAALEVPVEEARRFGVFCVDDDNRVTAFEEKPANPVTIPGRETCFASMGNYIFSTRRLIEVLQEGKKLHADLDFGKHVIPMMLAKKDRVFAYNFNDNLIPGMKPEERGYWKDVGTIDSYYEANMELIHVSPQLNLYNYKWPILTNQGNYPPAKTVFDEDGRRGMNIDSYVCAGCITSGSVVRRSIVGPLTKVNSYSLVEDSILFENVNVGRNVKIRRAIIDKNITIPDGTTIGYDHGEDRRRGYTVTESGIVVVSPAE

SEQ ID NO: 28545 - protein, 161 aa, Unknown
  Polaromonas sp. JS666
MNTVYAFEARQINGQNIPLSEFSGKVMLIVNTASQCGFTPQFGGLEELHKTYAGKGLAVLGFPCNQFGSQDPGSDGEIAEFCQVNYGVSFPMMSKIDVNGPAAHPLYKWLTAEAPGLLGSKSIKWNFTKFLVGKNGQVIKRYAPTDKPAELARDIEAALAA

SEQ ID NO: 28546 - protein, 112 aa, Pseudoalteromonas tunicata
MKMISAIIKPFKLDDVREALSDLGVEGMTVVDVKGFGRQRGHTELYRGAEYQVDFIPKIKIEIATRSENLDRIVEAITKVASTGKIGDGKIFVYDLEQIVRIRTGELDEEAI

SEQ ID NO: 28547 - protein, 467 aa, Herminiimonas arsenicoxydans
MNKMLPDSTLPERTRSSTEYLLAAEEAALQAKRADPHSPYYIPPSATPDPTLQRRHFLMGAMAVVGAGAIRQARAAAPAGAVAREVPADATKVQGTPVGDDGGYGTRSQFETEVRTLYPNPTTFSSWTMTPLEKGMGIITPSGLHFERSHGGTPTIDPSKHSLYVHGMVKQPKKYSMADLKRFPSISRVHFIECSGNGLTEWSKPTLKTVQGTHGLTSTSEWTGVPLSTILGEVDVRSGAKWLLAEGGDAAVMTRSIPLEKAMKDCFLAYGQNGEAIRPEQGYPIRLMVPGYEGNMHIKWLRRLEISDKPFMTREETSKYTDLRPNGKAVQFSFEMDAKSVITSPSGEMQLDGAGFYEITGLAWSGRGRVKRVEVSTDGGKTWKEAQLQGPIMSICHTRFRFPWKWNGRETVIQSRCIDETGYMQPTLKQLVNLRGLNGPLGSIYHLNAIQSWKIANDGKVSNVHQS

SEQ ID NO: 28548 - protein, 572 aa, Neurospora crassa
MSDIEKGSAGSHDKETRVDAATLPAYEAGSVAEAQQEDFMTRNGLNLASFKPRRFHTGDGTEIERTMKSRHLHMIAIGGSIGAGFFVGSGKALHNGGPASLLIDFAIIGVMMFNVVYALGELAVMFPVTGGFYTYSTRFIDPSWGFAMGWNYVFQWAMVLPLELTVCGFTVGYWNQDITVWITTFLVAIIIINVFGTLGYAEEEFWASAFKLGATIVFLIICLVMVLGGGPKGSRYDHYTGAALWYSPGAFANGFRGFCSCFVTAAFAFSGTELVGLAAAEDKNPVKSLPGAIKQVFWRITLFYILGLFFVGLLIPYDDENLLGANPFINVNASPFVLVGKYANLTGFDSFMNVVILVSVLSLGVSCVYGGSRTLTALAQQGYAPKIFTYVDRSNRPLFSVLLIIAFGPLAYVNLAAAGPTVFDWLLSLSGLAALFTWGSICLSHIRFRKAWALKGHSVEEIPFRAAGGVWGSWLGLVLVVLVLIAQFYVAICPPGGGFNTVEGFFVQYLALPVVIVFWIGGFIWKRTSWLRVDQIDVDTGRREHDWESINAYQAELAAMPAWKRWFHKLFV

SEQ ID NO: 28549 - protein, 314 aa, Unknown
  Candidatus Kuenenia stuttgartiensis
MNRDYDVIIVGGGPAALAAAVYTCRALLKTVVFERKITGGQLAGTDMIENYPGFPDVISGVDLTQRMEEQAKRFGLIVRYEEVLKLTVEDGLKVVTTDTGVYASYAVILACGADPRKLDIPGENEFYGRGVSYCATCDGAFFRDKDVVVVGGGDSALTEGIFLTKYVKTVQIIHRGEAFKAAKIYQEDAFANPKIHVSFNTTVEEIHGKESVEGIITRNVVTGEKNSLPCQGIFIFIGSVPNTSFLGNLLCVDTGCHIETNMHMETEIEGVYAVGDVRKWSYRQIATSVGDGVTAAIAAEHKLAELKALGKIKN

SEQ ID NO: 28550 - protein, 419 aa, Prosthecochloris aestuarii
MTMKDTILDNLVHVREASRLLATRSEKEINGILLDLAGRIAERAPIIIEANQKDLDRMDPNDPKYDRLLLTEERLKAIAADIENVVTLPAPTGRILEQRTLPNGLELRRQTVPLGVIGIIYESRPNVTFDVFALCLKSGNATVLKGGSDARDSNIAIVNLIHEVLLDNGMNAETIYLLPAEREAAGVMLNAVGSIDIIIPRGSQQLIDYVRTHSTVPVIETGAGIVHTYFDASGELDMGRQIVLNAKTRRPSVCNALDTLIMHRDQLNDLAAIAEPLAEKQVIIFADEEAYPSLLGRYPSELLQKAEEKHFGTEFLSLKMSVKTVGNLEEALAHISRYSSMHSEAIIATDPEVRDAFLQRVDAAVVYANTSTAFTDGAQFGLGAEIGISTQKLHARGPMALKELCTYKWIIEGNGQVRS

SEQ ID NO: 28551 - protein, 112 aa, Methylococcus capsulatus
MKFVTAILKPFKLDDVREALSEVGITGITVTEVKGFGRQKGHTELYRGAEYVVDFLPKVKLEVAITDDQLEAVIDAITKTANTGKIGDGKIFVADLEQVVRIRTGETGPDAL

SEQ ID NO: 28552 - protein, 412 aa, Triticum aestivum
  misc_feature (300)..(300): Xaa can be any naturally occurring amino acid
MNALAATSRNFRQAARLLGLDSKLEKSLLIPFREIKVECTIPKDDGTLASFVGFRVQHDNARGPMKGGIRYHPEVDPDEVNALAQLMTWKTAVAAVPYGGAKGGIGCSPGDLSRSELERLTRVFTQKIHDLIGTHTDIPAPDMGTNSQTMAWIFDEYSKFHGHSPAVVTGKPIDLGGSLGRDAATGRGVMYATEALLAEYGKSISGSTFVIQGFGNVGSWAAQLIHEKGGKVIALGDVSGTIRNKAGIDVPALMKHRNEGGQLKDFHGAEVMDASELLVHECDVLLPCALGGVLNRENAXPDVKAKFIIEAANHPTDPEADEILTKKGVVVLPDIYANAGGVIVSYFEWVQNIQGFMWEEEKVNMELHKYMNSAFQNIKAMCKSQDCNLRMGAFTLGVNRVARATILRGWEA

SEQ ID NO: 28553 - protein, 376 aa, Unknown
  uncultured archaeon GZfos28G7
MAGVRDISKAKRIVIKVGTSNLTDTSYRLDPRKVEKLAKEIIELKNEGKEVIVVTSGAIGAGIGKLDLKQRPRDIKVLQATAAVGQNILMSTYDRYFAKYEQTIAQLLLTHDNFFNRQRYLNLRNTLITLLKSGVIPIINENDTVAVDEIKLGDNDNLSALVASSLGADLLIILTDIDGLYTYDPKRSEKAEFISVVEDITPEIERIASGRGKTGVGGMKTKVQAAEVTMKAGIPMVIANGGEENILRRVIAGEPVGTLFMPKKKRMNDKEHWILFSASPKGKIKVDEGAKTALVEGGGSLLPSGITDVEDEFIRGDPVSIIDVQSVEFARGITNYSSAEIKKIKGVQSKEIEQILGRKGYGYGEVVVYRGNLVLL

SEQ ID NO: 28554 - protein, 718 aa, Candida albicans
MSRDTPDSLSSSLSSATPHYHPHKHDKKKSMLHYFQLIIRSITYDLVLFFFDCVIHTFFRDIRSTGNFNIPQEGPVIFVIAPHHNQFVDGLVVMTKVKEISNRRIAFLIAKKSYDRMVIGQAAKLCGCIPVERAQDFLKLGQGKVFVDPNDDCVLIGENTAFTKQCQKKGLIGLPNSLGNCQIASIEDDTHLTLTKPFGSKNSEIQSRIDKAFRDGTSFKIAPHIDNHVVFENVFNHLNDGNILGIFPEGGSHDRPDLLPLKPGVAIMALGAIAQQMEECEENDNNGKEQKEIQPISVVPVGLNYFHPNKFRSRVVIEFGKPIVVDQSMGKEYMEHHRDTVDKLLKVVTFGLKQVTLTCDDYDTLMVLQAARRLYTSTNREQIPLPMVVEMDRRLIKGYQQYKDEPDVKKLRDAVYHYNRTLMRLNLHDHQVESLDKFDKLKTFQMFVSRFFKFSLFMGLSLPGIILFSPVFITSKKISVRKAKEALAASSVKIKAKDVISTWKILVALVLAPALYIFYSVIGTYLIVKSQIVPQLSTIIIFIICYGWAVLTTYASLRVGEIGVDYYKSLKPLFISLISYEKDQLQIRELKKTREELRQRVNLFCNNYGPGMFQDYDEFYRNYNQMETETDYDEFKQSHKPLRRQNSWTSMDLTLNNLSDIPIFSAADLEQSNDISTSESSDEVNDEKEVEVEDVGDHSNEVSVRLRNAIRERRQNSF

SEQ ID NO: 28555 - protein, 490 aa, Staphylococcus aureus
MTSKSSPLIFERSREGRYAYSLPKSDIKTNSVESLLDDKFIRKNKAEFPEVAELDLVRHYTELSNKNFGVDNGFYPLGSCTMKYNPKINEKVARIPGFSESHPLQDEDQVQGSLEIIYSLQEELKEITGMDEVTLQPAAGAHGEWTALMIFKAYHENNGEGHRDEVIVPDSAHGTNPASASFAGFKSVTVKSNERGEVDIDDLKRVVNENTAAIMLTNPNTLGIFEKNIMEIREIVHNAGGLLYYDGANLNAIMDKVRPGDMGFDAVHLNLHKTFTGPHGGGGPGSGPVGVVKELASYLPKPMVIKDGDKFKYDNDIKNSIGRVKPFYGNFGIYLRAYTYIRTMGATGLKEVSEAAVLNANYIKARLSKHFEIPYKQYCKHEFVLSGVRQKEFGVRTLDMAKRLLDFGVHPPTIYFPLNVEEGMMIEPTETESKETLDYFIDTLISIAEEAKNDPDKVLEAPHTTVIDRLDEATAARKPILKFENLKQEK

SEQ ID NO: 28556 - protein, 164 aa, Ashbya gossypii
MYVPPRDYKDLHALTEDFESFYEDVFLEAARFGEVQELIVCENKTDHLNGNVYIRYSTIDAAKAARDALITRWYGERPLYCDLSHVTDFREAVCKSYEEGTCDRGEQCNFIHRRIIGYHIANGLMLSQWKSRHIMPQHRSDEARNTGHVAHSSAAVTAPLPPSA

SEQ ID NO: 28557 - protein, 448 aa, Staphylococcus aureus
MSHRYIPLTEKDKQEMLQTIGAKSIGELFGDVPSDILLNRDLNIAEGEAETTLLRRLNRIASKNITKETHTSFLGAGVYDHYAPSVVDAMISRSEFYTAYTPYQPEISQGELQAIFEFQTLICELTDMDVANSSMYDGMTSFAEACILAFSQTKKNKIVVSKGLHYQALQVLHTYAKTRKEFEVVEIDLDGTVTDLKKLEAAVDDETAAVAVQYPNFYGSIEDLEKIHSFIEDKKALFIVYANPLALGLLTPPGSFGADIVVGDTQPFGIPAQFGGPHCGYFATTKKLMRKVPGRLVGQTQDDEGNRGFVLTLQAREQHIRRDKATSNICSNQALNALASSIAMSALGKQGIYDIAVQNIEHANYAKQQFIKKGFEVLDGTSFNEFVVKFDKPIQQVNEELVKYNIIGGFDLGVVSDDFKNHMLIAVTELRTKDEIDTFVEKAGELND

SEQ ID NO: 28558 - protein, 395 aa, Prosthecochloris aestuarii
MKRDYYEVLGVGRSATKDEIKKAYRKLAMKYHPDKNPDNSEAEEKFKEANEAYEVLSNDDKRRRYDQFGHAGVGSSASSQGGPFGGGGTGDLGDIFSAFNDMFGGGARGGGSPFGFEDVFSGGGGRRSRSAGVSGSDLKIRLKLSLEEIAKGVEKTLKIKKQVACDVCNGTGSKTGELETCPTCQGTGEVRQASKTMFGQFVNIAACPTCGGEGRVVKERCTACHGEGIKQGETTVKVNIPAGVEDGNYLTLRGQGNAGPRGGMNGDLIVVIEEVEHKIFARRGDDVVYNLTLSYADMVLGTKVDIPTLEGRVKMTVPPATQPNTVLRISAKGIGHLKAPGRGDHLVRVNVFVPKDPSHQDKELLKELNKSVHMVPDEKKEHEKGFYEKVKDIFS

SEQ ID NO: 28559 - protein, 631 aa, Bordetella bronchiseptica
MIHLDGAAVDPAVLQGMTDAIAHRGPDGEGHWIDGNVGLGHRRLAIIDLSPAGHQPMISADSRYVLSYNGEIYNFRELRAELQGEGCQFRSQTDSEVLLHALIVWGVERTLSRLNGMFAFAWWDTRERKLLLARDRYGVKPLYFSMQGTTLAFGSEQKAILASAAFRRNLNKAALLEYFTFQNIFTDQTLLEDVHLLPAGHYAYLDCAKERPQLRLTQYWDFNFHEPAVPGTDTEYREELSRLFRQAVQRQLVSDVELGSYLSGGMDSGSITAVAAASHPYIKTFTCGFDLNSASGIELAFDERSKAEYMSYFFKTEHYEMVLKSGDMERVLPALAWHLEEPRVGQSYPNYYAAKLASKFVRVVLSGAGGDELFGGYPWRYYRAVVNNDFEHYVDKYYLFWQRLIPNSTLKQVFRPVWSDVSHVWTRNIFRDVFNSHADQLYSPEDYINHSLYFEAKTFMHGLLVVEDKLSMAHGLESRVPFLDNDLVDFATRCPVRLKLNNLADVIKLNENEPGHKTNKYFEKTRDGKQILRDVMRDYIPSDIAQAEKQGFSAPDASWFKGESMDFVKRTLFSKHARIYEIMDADTVRSLVAEHLSGERNRRLLIWSLLNVESWLAQYLDHGGVAGKGLA

SEQ ID NO: 28560 - protein, 108 aa, Prochlorococcus marinus
MSEYNIKVELEKKTYVFLCPEDQDIISAAKANGIDLPSSCCSGVCTSCASMVIDGSVEQEDAMGLNDDLKEKGFALLCVAYPKSDLHIIIGDEVEDNLYNNQFGKYQI

SEQ ID NO: 28561 - protein, 541 aa, Medicago sativa
MAIEMSSIVSKLSMLSTSDHASVVSMNLFVALLCACIVLGHLLEENRWMNESITALLIGICTGVVILLFSGGKSSHILVFSEDLFFIYLLPPIIFNAGFQVKKKQFFVNFMTITSFGAIGTLISCVIITTGATFAFKRMDIGPLEIGDYLAIGAIFAATDSVCTLQVLNQDETPLLYSLVFGEGVVNDATSVVLFNAIQSFDLNQLNPSIALHFLGNFLYLFVASTLLGVVTGLLSAYVIKKLYIGRHSTDREVALMMLMAYLSYMLAELTYLSGILTVFFCGIVMSHYTWHNVTQSSRITTKHSFATLSFVAEIFIFLYVGMDALDIEKWKFVSDSPGTSIAASSVLLGLILLGRAAFVFPLSFLSNLTKKSQHQKISFRQQVIIWWAGLMRGAVSMALAYNQFTMSGHTQLRSNAIMITSTITVVLFSTVVFGLLTKPLIRLLLPHPKITSSMTTTESTTPKSFIVPLLGDSRDSEADLEGHEIHRPNSLRALLSTPTHTVHRLWRKFDDSFMRPVFGGRGFVPVEPGSPSERNGNQWG

SEQ ID NO: 28562 - protein, 309 aa, Methanosarcina barkeri
MYDLIIIGGGPAGLAAGIYAVRSGLNTLILERSEISGQIALSDIVENYPGFPAISGLELMEKYKAHAQAVGVETKITEVLSVRAEGEKKIISTDSGDLESIAVIVATGANPKHLNVPGEKEFISKGVSYCAICDGPFFKNKTVVVVGGGNSAVTDALLLSKIARKVYLIHRREQLRAVKVLQDRVFATPNIEFIFNAQILEIMGSSGGVRRVEKIRFKDLKSEEQRELATDGVFIYVGIHPNTEIIDVDKDDEGFITTDRFLETSKKGIYAVGDCRDTPIWQLVAAVRDGALAATAANVYIESIKKETT

SEQ ID NO: 28563 - protein, 443 aa, Salmonella enterica
IGVVGMAVMGRNLALNIESRGYTVSVFNRSREKTEEVIAENPGKKLVPYYTVKEFVESLETPRRILLMVKAGAGTDATIDSLKPYLEKGDIIIDGGNTFFQDTIRRNRELSAEGFNFIGTGVSGGEEGALKGPSIMPGGQKDAYELVAPILTKIAAVAEDGEPCVTYIGADGAGHYVKMVHNGIEYGDMQLIAEAYSLLRGGLNLSNEELASTFTEWNNGELSSYLIDITKDIFTKKDEDGNYLVDVILDEAANKGTGKWTSQSALDLGEPLSLITESVFARYISSLKAQRVAASKVLSGPKAQLAGDKAEFIEKVRRALYLGKIVSYAQGFSQLRAASEEYHWDLNYGEIAKIFRAGCIIRAQFLQKITDAYAENAGIANLLLAPYFRKIADEYQQALRDVVAYAVQNGIPVPTFSAAVAYYDSYRAAVLPANLIQAQRDYF

SEQ ID NO: 28564 - protein, 443 aa, Salmonella enterica
IGVVGMAVMGSNLALNIESRGYTDSVFNRSREKTEEVITENPGKKLVPYYTVKEFVESLDTTRRILLMVKAGAGTDAAIDSLKPYLEKGDIIIDGGNIFFQDTIRRNRELSAEGFNFIGTGVSGGEEGALKGPSIMPGGQKDAYELVAPILTKIAAVAEDGEPCVTYIGADGAGHYVKMVHNGIEYGDMQLIAEAYSLLKGGLNLSNEELASTFTEWNNGELSSYLIDITKDIFTKKDEDGNYLVDVILDEAANKGTGKWTSQSALDLGEPLSLITESVFARYISSLKANRVAASKVLFGPKAHPAGDKAEFIGKVRRALYLGKIVSYAQGFCQLRAASDEYHWDLNYGEIAKIFRAGCIIRAQFLQKITDAYAENAGIANLLLAPYFKKIADEYQQALRDVVAYAVQNGIPVPTFSAAVAYYDSYRAAVLPANLIQAQRDYF

SEQ ID NO: 28565 - protein, 434 aa, Unknown
  Acidovorax sp. JS42
MSNTPNPPLPTHALPSYLDPNHLGPWGVYLQQIDRVTPYLGSLARWVETLKRPKRALIVDVPIELDNGTIAHFEGYRVQHNVSRGPGKGGVRFHQDVTLSEVMALSAWMSIKNAAVNVPYGGAKGGIRVDPKTLSKAELERLTRRYTSEIGIIIGPSKDIPAPDVNTNAQVMAWMMDTYSMNVGTTATGVVTGKPVDLGGSLGRVEATGRGVFTVGVEAARLTGMAIEGARVAVQGFGNVGGTAGKLFAEAGAKVVAVQDHTGSIHNDKGLDVPALLAHVQRTGGVGGFAGAEPMANDAFWGVACDILIPAALESQITKDNAGRIQAKMVIEGANGPTTPEADDILNDKGVLVLPDVISNAGGVTVSYFEWVQDFSSFFWTEDEINARLVRIMKEAFAGVWQVAQENKVTLRTATFIVACKRILHAREMRGLYP

SEQ ID NO: 28566 - protein, 167 aa, Lotus japonicus
MAEQTSKSLYDFTVKDIRGNDVSLSQYSGKVLIIVNVASQCGLTQTNYKELNILYEKYKSKGLEILAFPCNQFAGQEPGTNDEIQDVVCTRFKSEFPVFDKVEVNGKNAEPLFKFLKDQKGGIFGDGIKWNFTKFLVNKEGKVVERYAPTTSPMKIEKDLEKLLQSS

SEQ ID NO: 28567 - protein, 443 aa, Salmonella enterica
IGVVGMAVMGRNLALNIESRGYTVSVFNRSREKTEEVIAENPGKKLVPYYTVKEFVESLETPRRILLMVKAGVGTDAAIDSLKPYLEKGDIIIDGGNTFFQDTIRRNRELSAEGFNFIGTGVSGGEEGALKGPSIMPGGQKDAYELVAPILTKIAAVAEDGEPCVTYIGADGAGHYVKMVHNGIEYGDMQLIAEAYSLLKGGLNLSNEELASTFTEWNNGELSSYLIDITKDIFTKKDEDGNYLVDVILDEAANKGTGKWTSQSALDLGEPLSLITESVFARYISSLKAQRVAASKVLSGPKAQPAGDKAEFIEKVRRALYLGKIVSYAQGFSQLRAASDEYHWDLNYGEIAKIFRAGCIIRAQFLQKITESYAENAGIANLLLAPYFKKIADEYQQALRDVVAYAVQNGIPVPTFSAAVAYYDSYRAAVLPANLIQAQRDYF

SEQ ID NO: 28568 - protein, 555 aa, Unknown
  Shewanella sp. MR-4
MTESFADLFEQSLQTLEFRPGSIVRGTVVAIENGMVLVDAGLKSESPIPAEQFKNAQGVLEIAVGDEVDVALDSVEDGFGETQLSREKAKRHEAWIVLEKAYEDAETVIGIINGKVKGGFTVELNGIRAFLPGSLVDVRPVRDTAHLEYKELEFKVIKLDQKRNNVVVSRRAVIESESSAERDALLENLQEGQAVKGIVKNLTDYGAFVDLGGVDGLLHITDMAWKRVKHPSEIVNVGDEINVKVLKYDRERTRVSLGLKQLGEDPWLEISKRYPENTKLTGRVTNLTDYGCFVEIEEGVEGLVHVSEMDWTNKNIHPSKVVNLGDEVEVLVLDIDEERRRISLGLKQCKTNPWDDFATRYNKGDKVSGKIKSITDFGIFIGLDGGIDGLVHLSDISWNGTGEDAVSEYKKGDEIHAVVLSVDPERERISLGVKQTEDDPFNAYLADKKKGTIVNGTVSAVDAKGVTVELADTVEGYIRVADISRERIEDASTVYSVGDAIEAKFMGVDRKNRSISLSIKAKDEAEEKEVMATLNKQEDAVISNAMAEAFKAARK

SEQ ID NO: 28569 - protein, 443 aa, Salmonella enterica
IGVVGMAVMGRNLALNIESRGYTVSVFNRSREKTEEVIAENPGKKLVPYYTVKEFVESLETPRRILLMVKAGAGTDAAIDSLKPYLEKGDIIIDGGNTFFQDTIRRNRELSAEGFNFIGTGVSGGEEGALKGPSIMPGGQKDAYELVAPILTKIAAVAEDGEPCVTYIGADGAGHYVKMVHNGIEYGDMQLIAEAYSLLKGGLNLSNEELANTFTEWNNGELSSYLIDITKDIFTKKDEDGNYLVDVILDEAANKGTGKWTSQSALDLGEPLSLITESVFARYISSLKVQRVAASKVLSGPKAQPAGDKAEFIEKVRRALYLGKIVSHAQGFSQLRAASDEYHWELNYGESAKIFRAGCIIRAQFLQKITEAYVENAGIANLLLAPYFKKIAYEYQQALRDVVAYAVQNGIPVPTFSAAVAYYYSYRAAVLPANLFQAQRDYF

SEQ ID NO: 28570 - protein, 444 aa, Oryza sativa
  misc_feature (409)..(409): Xaa can be any naturally occurring amino acid
MASISGAAAPPSSSAACRLRLRRQLLLRPSHLRLRAPHSIADLSRSSSSSSEQQPSSTPAAPLASRPGQNGSTRGAVEKDPIKLWERYVEWLYQHKELGLFVDVSRMGFTEEFLRRMEPRMQRAFAAMRELEKGAIANPDEGRMVGHYWLRDPGLAPNSFLRTKIETTLDRILAFSQDVVSGKIKPPSSPAGRFTQILSIGIGGSALGPQFVSEALAPDNPPLKIRFIDNTDPAGIDHQIAQLGPELASTLVIVISKSGGTPETRNGLLEVQKAFRDAGLDFSKQGVAVTQENSLLDNTARIEGWLARFPMFDWVGGRTSEMSAVGLLPAALQGIDIKEMLVGAALMDEETRNTVVKENPAALLALCWYWASEGIGNKDMVVLPYKDSLLLLSRYLQQLVMESLGKEFXTLDGHRVNQGLTVFGNKEADQEPNSHWKSVPLLRT

SEQ ID NO: 28571 - protein, 443 aa, Salmonella enterica
IGVVGMAVMGRNLALNIESRGYTVSVFNRSREKTEEVIPENPGKKLVPYYTVKEFVESLETPRRILLMVKAGAGTDAAIDSLKPYLEKGDIIIDGGNTFFQDTIRRNRELSAEGFNFIGTGVSGGEEGALKGPSIMPGGQKEAYELVAPILTKIAAVAEDGEPCVTYIGADGAGHYVKMVHNGIEYGDMQLIAEAYSLLKGGLNLSNEELASTFTEWNNGELSSYLIDITKDIFTKKDEDGNYLVDVILDEAANKGTGKWTSQSALDLGEPLSLITESVFARYISSLKVQRVAASKVLSGPKAQPAGDKAEFIEKVRRPLYLGKIVSYAQGFSQLRPASDEYHWELNYGEIAKIFRAGCIIRAQFLQKITDAYVENAGIANLLLAPYFKKIADEYQQALRDVVAYAVQNGIPVPTFSAAVAYYDSYRAAVLPANLIQAQRDYF

SEQ ID NO: 28572 - protein, 379 aa, Unknown
  Pseudoalteromonas sp. SM9913
MSKRDYYEVLGVSKDASERDIKKAYKRLAMKYHPDRTAGDKDLETKFKEVKEAYEILTDAQKRQMYDQYGHAAFEQGGGGGHGGFGGGQGDFGDIFGDVFGDIFGGGGGRRQSRQQRGSDLRYNMDLSLEEAVRGKDVEIKVPTWVSCEPCDGSGAKAGSKPKTCTTCHGAGQVQMRQGFFAVQQTCPTCHGQGQIISDPCNKCHGQGRVEKTKTLSVKIPAGVDTGDRIRLSGEGEAGMHGAPAGDLYVQVSVREHKIFVREANNLYCEVPISFTTAGLGGEIEVPTLDGRAKLKIPSETQTGKMFRMRGKGVKSVRSGAQGDLICKVVIETPVNLNERQRDLLKELDESMGKDSSKNRPKEQGFFDGVKKFFDDLTK

SEQ ID NO: 28573 - protein, 291 aa, Triticum aestivum
  misc_feature (111)..(111): Xaa can be any naturally occurring amino acid
MSADLNRDYEIGEEIGRGRFGVVHRCTSRSTGEAFAVKSVDRSNLADDLDRELAEIEPKLAQLAGAGNPGVVQVHAVYEDDSWTHMVMDLCSGPDLLDWVRLRRGAPVPEXPVAADIVAQLAQALALCHRRGVAHRDVKPDNVVLDVDDDGENSSPRARLADFGSAAWIGADGGRAEGLVGTPHYVAPEVVSGGDYGEKADVWSAGVVMYVLLSGGALPFGGETAKDVLSAVMRGSVRFPPRLFSGVSPAAKDLMRRMMCRDEWRRFSAEQVLRHPWIVSGGGARAMEQPT

SEQ ID NO: 28574 - protein, 522 aa, Pseudomonas fluorescens
MNAYSPPNDPEVVDIAIIGAGFAGLCMAIKLKQAGIEDFFVAEHAASLGGTWRDNHYPGCACDVQSHVYSFSFAPNPNWTRQFAPQPEIREYLENCARDFALAPYLHFNMGLQQAVFDEARERWHLRFSNGREVSARVLISGMGGLSRPAIPDIPGLDTFTGKRFHSQQWDHRYALQGKRVAVIGTGASAIQFVPKIAPRVAQLKLFQRTPPWIMPKPDRELSAVERWAFKHLPFTQRLVRSALYWALESRVIAFARRPRLMKVVQRVALRHLRKQVPDPVLRQRLTPDYTIGCKRILISNDYYPALTRGNVRLITDDIQRIDGDAVITADGNRHPVDCIIFGTGFQATDPIPRGLLFGRHGQDLMDSWARGAHAYLGTCLPGFPNFFMIVGPNTGLGHNSMILMIEAQVDYILKALDQMQRERIASIEVRPQVESQYNQRLQQRLAGAIWSTGGCRSWYLDPRSGQNTTLWPGSTWSFKKTLQHFELQDYQASHLPHTQPAAAPAAARPLHLEEAALNEKL

SEQ ID NO: 28575 - protein, 401 aa, Catharanthus roseus
MPKSWPIVISSHSFCFLPNSEQERKMKDLNFHAATLSEEESLRELKAFDETKAGVKGIVDTGITKIPRIFIDQPKNLDRISVCRGKSDIKIPVINLNGLSSNSEIRREIVEKIGEASEKYGFFQIVNHGIPQDVMDKMVDGVRKFHEQDDQIKRQYYSRDRFNKNFLYSSNYVLIPGIACNWRDTMECIMNSNQPDPQEFPDVCRDILMKYSNYVRNLGLILFELLSEALGLKPNHLEEMDCAEGLILLGHYYPACPQPELTFGTSKHSDSGFLTILMQDQIGGLQILLENQWIDVPFIPGALVINIADLLQLITNDKFKSVEHRVLANKVGPRISVAVAFGIKTQTQEGVSPRLYGPIKELISEENPPIYKEVTVKDFITIRFAKRFDDSSSLSPFRLNN

SEQ ID NO: 28576 - protein, 312 aa, Unknown
  Burkholderia sp. 383
MFRHGFPSNRPPPIIQTSELPALSGPPVSTTLLFHPTPDAAYGFPNARRLARVASPHQQIEVWETPQLGRLFTLDGRPMTSVGDEYVYHECMTHPAALAHPAPRRALVLGGGDGGAARQLLKHACIERIVIAELDDEVVGMARRYLDDVHQGALDDPRVEVVIGDAAHFVESTVEHFDLVVFDLTPPDSPAAGLYTRAFYARLKRILTPCGAISMHLGSPVFHAARIAALLDDLRACFAVVDPLSAHVPLYGSQWLMAIASDTLDAAALFAHDIDERLAARRVQGLRYYDARLHASLFALPCALRDTLGVRR

SEQ ID NO: 28577 - protein, 380 aa, Pseudomonas syringae
MAKRDYYEVLGVERGSSEADLKKAYRRLAMKHHPDRNPDDKASEELFKEANEAYEVLSDASKRAAYDQYGHAGVDPSMGGGGGFGGGAGGANFSDIFGDVFSDFFGGGRGGGGGGRGGAQRGSDLRYTLELNLEEAVRGTNVNIRVPTLVNCKPCDGSGAKKGSSPVTCPTCGGIGQVRMQQGFFSVQQTCPRCHGHGKIISDPCDSCHGEGRVEESKTLSVKVPPGVDTGDRIRLSGEGEAGTQGGPTGDLYVVINVREHAIFQRDGKHLFCEVPISFTDAALGGELEVPTLDGRVKLKIPEGTQTGKQFRLRGKGVAPVRGGGAGDLMCHVAVETPVNLSKRQRELLEEFRTSLENDESHSPKASGWFEGVKRFFGDL

SEQ ID NO: 28578 - protein, 158 aa, Brassica napus
  misc_feature (153)..(153): Xaa can be any naturally occurring amino acid
MNSGSCSSLMEVGYDHHHHGHEELHVLAVDDNLIDRKLVEKLLKISSCKVTTAENAIRALEYLGLGDHNQHMALTNNNLKVNLIITDYCMPGMTGFELLKKVKESSNLKEVPVVIMSSEYIPTRISKCLASGAQMFMQKPLKLSDVEKLKCHXMNSRS

SEQ ID NO: 28579 - protein, 910 aa, Ashbya gossypii
MNNPLGQHGGGAVGLRAAQALAAGTGPHGANGGGSPSGGVAAIAADGAGGGAAVDPLSQSAAETWLSIASLAETLGDADRAAMAYDATLQYNPSSTKALTSLAHLYRSRDVFQRAAELYQRALAVNPELGDVWATLGHCYLMLDDLQRAYAAYQQALYHLSNPNVPKLWHGIGILYDRYGSLDYAEEAFAKVLELDPHFEKVNEIYFRLGIIYKHQGKWNQALECFRYILPQPPAPLQEWDVWFQLGSVLESMGEWQGAREAYEHVLSQNDRHAKVLQQLGCLYGMNNVQFYDPQTALNLLLKSLEADSTDATTWYHLGRIHMVRNDYTAAYDAFQQAVNRDSRNPTFWCSIGVLYYQISQYRDALDAYTRAIRLNPYISEVWYDLGTLYETCNNQLSDALDAYKQAVRLDPNNVHIRERLEALTAQLANPGAQQPQQQPQQQQMQQPRGPAPIMLQPTLQQQDQTNPLNNKPAFYRSSPHGVAVAGTESAGHTPMSGRPQPLQQLNNNGSILEPSLLPQKRPMEGGMDTLVNAISQQELQQHQKKHMPSQNHPSLALATGQPQQLPPDAAPIIPPEKKGAPLPQFQKTEPEHAAKRLKHEQNYVEEQPVRSRTIPSITHPASMDHSGPGDQNHILSGPSVHATHVLPPVAVAAKGSERSQPVANGSTIKDLHATNTLPPVTGPIVNSDKLGSKAPPDTSKEAAHATAQAGFHDKVSPGQPDVGEKPKDSREVKSANTASTGAPVRNLPPLATAASPECSSTHTEISAAPSESITAAASENLEDQEPNLKTNSASSAVDLAERQKSSTEVATDYHPAAETAPTASNKLRSTDPPAPPDLHQPPAAESAEPTAIKPSADAIEKLQEEARMRQEEELEALQKKAAHNGVGTSTDLPKESVIRKVEEDENYDD

SEQ ID NO: 28580 - protein, 424 aa, Ashbya gossypii
MVNTTALIRSPTFVAQFRVLKQVNRGLFSQTSYARTHARTSYTHTMAGTDRLQQTSQILSRSTSSEIRLERPFKVTVIGSGNWGTTIAKVVAENTQEYPQLFERRVDMWVFEEQIEGRKLTEIINEQHENVKYLPGITLPENLVANPSVAAAAADADVLVFNIPHQFLGRIVEQLKGHVKPGARAISCLKGFSVGKDGVQLLSTYIEEHLHIPCGALSGANLAPEVAKGNWSETTVAYTLPQDFRGTGKDVDHAVLKKLFHRPYFHVNVVDDVAGISVAGALKNVVALACGFVLGLGWGNNAAAAVQRVGLSEMIKFARMFFPESKVETFYQESAGVADLITTCAGGRNVRIGRAMAETGKSAQELEKELLNGQSSQGIYTTQEVHEWLQQCGKKDEFPLFEAVYKIVYEGVPMSKLPDMLEDA

SEQ ID NO: 28581 - protein, 563 aa, Clostridium thermocellum
MRKIAVLLITLTFLVTTLFSMSFSSAAASHDYATALKYSILFYDANKCGPDAAVDNVFSWRGPCHTTDGSEIGLDLTGGYHDAGDHVKFGLPQAYAAAVLGWSLYEYKGVFDATGNTSKMLSTLKYFTDYLLKCHPDSNTFYYQVGDGQADHTYWGAPEVQPGPRPVPYVANASNAASDVRGLTSAALTIMYLNYKDIDQNYANKCLKAAKELYTMAKTNLGYYAENAFYISHSYWDDLSFAATWLYVVEKDPTYLKEIDSYLSNKTLWGESPFNNKWTMCWDDMYMAVFCKLAEITGEQKYIDAMNYNLDYWMNSLNTTPGGLKYLDSWGVLRYAAAEAFIAMRYYELTKNEALKSFAKSQIDYILGSNPINMSYVIGYGSNYPKCPHHRAANGYTYANGDNAKPAKNLLLGALVGGPNMSDNFIDDVNQFQFTEVAIDYNAAFVGALAAIEKYYGNIVIPTPPATTPPSPTATPSLIWCDVGDLNVDGSINSVDITYMKRYLLRSISVLPYQENERIRIPAADTNGDGAINSSDMVLLKRYVLRSISEFPVKYDIYGNIIN

SEQ ID NO: 28582 - protein, 165 aa, Glycine max
DDDDDLGIMDIDENDSKSGKNSVELEALNKSLKDLLDGIQEDFAAVVDWAHKIDPLCCISMHGITERYLSGQKADAAGFVRILLRDLESRISMQFNRFVDEACHQIERSERNVRQTGVLPYIPRFASLATRMEQYVAGQSRDLVDQAYTKFVSDSLRTLSSFRVS

SEQ ID NO: 28583 - protein, 112 aa, Blastopirellula marina
MKKIEAIVRHHKLDEIKDALVSKGFGGMTAIEVQGFGRQKGQTETYRGAEYSIDFVPKIKIEIVATDEQFQEIVDTIIEKAQSGQIGDGKIFVSELTDVIRIRTAESGSAAI

SEQ ID NO: 28584 - protein, 466 aa, Leifsonia xyli
MRKTNADDRPAVVWFRDDLRLADNPALHAAAESGRPVICLYVWDEDSPGLRSPGEAARWWLHHSLTSLEESIGRAGSALAIRTGPAERVLAEVLAEVDAGAVFWNRRYGEGERRVDERVKSAARDTGLVANSFGANLLFEPWTVRTGSGTAFSVYTPFWRACLARPEPRRPLPALRRLRPGPSLPSLELDELKLLPVHPDWADGLRETWKPGERAAHRELSAFLGEGLARYRAERDVPGIAATSRLSPRLRWGELSPFQVWHATAAARDRSTAEGAATFLSELGWREFAYHTYFERPALATVNIHREYDSFPWPRLHPSALRAWQQGRTGVPLVDAGMRELWRTGVMHNRVRMVAASFLTKNLLIDWRRGEQWFWDTLVDADPASNPFNWQWVAGSGADTAPYFRVFNPEVQREKFDPHGDYVRRWVPEWDTADYPEPLVDLAETRRAALAAWETVKAARGTAERS

SEQ ID NO: 28585 - protein, 115 aa, Taxodium distichum
  misc_feature (4)..(4): Xaa can be any naturally occurring amino acid
  misc_feature (8)..(8): Xaa can be any naturally occurring amino acid
AGPXQGWXTLNQSKPIGSLPLMNTGALMKQWKMGLKAKRSVKAAFKVKLVTPDGETEIECPDDQYILDVAEEAGIDLPYSCRSGSCSSCAGKVIAGNVEMEDQSFLDDEQIENGF

SEQ ID NO: 28586 - protein, 443 aa, Salmonella enterica
IGVVGMAVMGRNLALNIESRGYTVSVFNRSREKTEEVIAENPGKKLVPYYTVKEFVESLETPRRILLMVKAGAGTDAAIDSLKPYLEKGDIIIDGGNTFFQDTIRRNRELSAEGFNFIGTGVSGGEEGALKGPSIMPGGQKEAYELVAPILTKIAAVAEDGEPCVTYIGADGAGHYVKMVHNGIEYGDMQLIAEAYSLLKGGLNLSNEELASTFTEWNNGELSSYLIDITKDIFTKKDEDGNYLVDVILDEAANKGTGKWTSQSALDLGEPLSLITESVFARYISSLKVQRVAASKVLSGPKAHPVGDKAEFIEKVRRALYLGKIVSYAQGFSQLPAASDEYHWELNYGEIAKIFRAGCIIRAQFLQKITDAYVENAGIANLLLAPYFKKIADEYQQALRDVVAYAVQNGIPVPTFSAAVAYYDSYRAAVLPANLIQAQRDYF

SEQ ID NO: 28587 - protein, 112 aa, Prochlorococcus marinus
MKKIEAIIRPFKLEDVKIALVNSGIVGMTVSEVRGFGRQKGQVERYRGSEFTVEFLQKLKVEVVVENEKVSSVIDAIAEAAKTGEIGDGKIFISSIDSVVRIRTGDTDEEAL

SEQ ID NO: 28588 - protein, 443 aa, Salmonella enterica
IGVVGMAVMGRNLALNIESRGYTVSVFNRSREKTEEVIAENPGKKLVPYYTVKEFVESLETPRRILLMVKAGAGTDAAIDSLKPYLEKGDIIIDGGNTFFQDTIRRNRELSAEGFTFIGTGVSGGEEGALKGPSIMPGGQKDAYDLVAPILTKIAAVAEDGEPCVTYIGADGAGHYVKMVHNGIEYGDMQLIAEAYSLLKGGLNLSNEELANTFTEWNNGELSSYLIDITKDIFTKKDEEGNYLVDVILDEAANKGTGKWTSQSALDLGEPLSLITESVFARYISSLKAKRVAASKVLSGPKAHFGGDKADFIEKVRRALYLGKIVPYAQGFSQLPAASDEYHWDLNYGKIAKIFRAGCIIRAQFLQKITDAYAENAGIANLLLAPYFKKIADEYQQALRDVVAYAVQNGIPVPTFSAAVAYYDSYRAAVLPANLIQAQRDYF

SEQ ID NO: 28589 - protein, 443 aa, Salmonella enterica
IGVVGMAVMGRNLALNIESRGYTVSVFNRSREKTEEVIAENPGKKLVPYYTVKEFVESLETPRRILLMVKAGAGTDGAIDSLKPYLEKGDIIIDGGNTFFQDTIRRNRELSAEGFNFIGTGVSGGEEGALKGPSIMPGGQKDAYELVAPILTKIAAVAEDGEPCVTYIGADGAGHYVKMVHNGIEYGDMQLIAEAYSLLKGGLNLSNEELANTFTEWNNGELSSYLIDITKDIFTKKDEEGNYLVDVILDEAANKGTGKWTSQSALDLGEPLSLITESVFARYISSLKANRVAASKVLSGPKAQPAGDKAEFIEKVRRALYLGKIVSYAQGFSQLRAASDEYHWDLNYGEIAKIFRAGCIIRAQFLQKITDAYAENADIANLLLAPYFKKIADEYQQALRDVVAYAVQNGIPVPTFSAAVAYYDSYRAAVLPANLIQAQRDYF

SEQ ID NO: 28590 - protein, 443 aa, Salmonella enterica
IGVVGMAVMGRNLALNIESRRYTVSIFNRSREKTVEVIAENPGKKLVPYYTVKEFVESLETPRRILLMVKAGAGTDAAIDSLKPYLEKGDIIIDGGNTFSQDTIRRNRELSAEGFNFIGTGVSGGEEGALKGPSIMPGGQKDAYELVAPILTKIAAVAEDGEPCVTYIGADGAGHYVKMVHNGIEYGDMQLIAEAYSLLKGGLNLSNEELANTFTEWNNGELSSYLIDITKDIFTKKDEDGNYLVDVILDEAANKGTGKWTSQSALDLGEPLSLITESVFARYISSLKAQRVAASKVLSGPKAQPAGDKAEFTEKVRRALYLGKIVLYAQGFSQLTAASDEYHWDLNYGEIAKIFRAGCIIRAQFLQKITDAYAENAGIANLLLAPYFRKIADEYQQALRDVVAYAVQNGIPVPTFSAAVAYYDSYRAAVLPANLIQAQRDYF

SEQ ID NO: 28591 - protein, 284 aa, Brassica napus
MMFEKDDLGLSLGLNLPKKQMNLKSNPSVSLTPSSSSFGLLRRSSLNESFNSSVPYSDSSRVETRTFIRGIDVNQPPSTAEYGDKDAGVSSPNSTVSSSTGKRSEREEDTDPQGSRGISDDEDGDNSRKKLRLSKDQSAILEETFKDHSTLNPKQKQALAKQLGLRARQVEVWFQNRRARTKLKQTEVDCEFLRRCCENLTDENRRLQKEVTELRSLKLSPQFYMHMNPPTTLTMCPSCEHVSVPPPPQVAASGHHQRSLPVNPWAPATRVSHGLTFDAFRPRS

SEQ ID NO: 28592 - protein, 443 aa, Salmonella enterica
IGVVGMAVMGRNLALNIESRGYTVSIFNRSREKTEEVIAENPGKKLVPYYTVKEFVESLETPRRILLMVKAGAGTDAAIDSLKPYLEKGDIIIDGGNTFFQDTIRRNRELSAEGFNFIGTGVSGGEEGALKGPSIMPGGQKDAYELVAPILTKIAAVAEDGEPCVTYIGADGAGHYVKMVHNGIKYGVMQLIAEAYSLLKGGLNLSNEELANTFTEWNNGELSSYLIDITKDIFTKKDEDGNYLVDVILDEAANKGTGKWTSQSALDLGEPLSLITESVFARYISSLKDQRVAASKVLFGPKAQMGGGKAEFFEKVRRALYLGKIVSYAQGFSQLPAASDEYHWDLNYGEIAKIFRAGCIIRAQFLQKITDAYAENAGIANLLLAPYFKKIADEYQQALRDVVAYAVQNGIPVPTFSAAVAYYDSYRAAVLPANLIQAQRDYF

SEQ ID NO: 28593 - protein, 432 aa, Rhodopseudomonas palustris
MSTANPASAPDSFFSASLEQADPEIAAAIRGELGRQRHEVELIASENIVSRAVLEAQGSVMTNKYAEGYPGNRYYGGCEFVDVAENLAIDRAKKLFGANFANVQPNSGSQMNQAVFLALLQPGDTFMGLDLAAGGHLTHGAPVNMSGKWFKPVHYTVRREDQMIDMDAVAKLAEEAKPKLIIAGGSAYPRAWDFKRFREIADSVGAYFMVDMAHFAGLVAGGVHASPVPHAHVTTTTTHKSLRGPRGGLILTNDEALAKKFNSAIFPGLQGGPLMHVIAAKAVAFKEALQPDFKVYTKNVVENAKALAETLRSAGFDLVSGGTDNHLMLVDLRPKGLKGNVSEKALVRAGITCNKNGIPFDPEKPFVTSGLRLGTPAATTRGFGVAEFQQVGHLIAEVLNAIAQSSDGAAPLVEASVKQRVKELTDRFPIYQ

SEQ ID NO: 28594 - protein, 628 aa, Lactobacillus acidophilus
MQANIKWLDDPEIFRVNQLPAHSDHPFFKNYREWQNNHSSFKQSLNGMWQFKFSKDPQSRPVDFYKKDFNTSSFTTIPVPSEIELNNFAQNQYINTLYPWEGKIFRRPAYALNKSDAEEGSFSEGKDNTVGSYIKHFDLNPELRDHDIHIVFEGAERAMYVWLNGHFIGYAEDSFTPSEFDLTKYIKEKDNILAVEVFKHSTASWLEDQDMFRFSGLFRSVELLAFPETHLVDLDLKPTVCDNYQDGIFNAELKFTGSLNGHVHLSVEDVNGSAILEQDVPLDSEVEFTSSTLENIHLWDNNHPYLYQLLIEVHDENGHLVELIPYQFGFRRIEINQDKVILLNGKCLIINGVNRHEWNAKTGRSITLNDMEKDIDTFKENNINAVRTCHYPNQIPWYYLCDQNGIYMMAENNLESHGTWQKMGQVEPSDNVPGSVPEWREAVIDRARNNYETFKNHTSILFWSLGNESYAGSNIVAMNEFYKEHDSSRLVHYEGVVHRPELKDQISDIESHMYLPPKEVAEYLRNNPQKPFMECEYMHDMGNSDGGMGSYIKLIDEYPQYVGGFIWDFIDQALLVYDPISKQNVLRYGGDFDDRHSDYEFSGDGLMFADRTPKPAMQEVRYYYGLHK

SEQ ID NO: 28595 - protein, 85 aa, Glycine max
VNRAQARMYVICTGHKYMVGFPTRKTNNDITCIVSNGGRVQCMQVWPPFGKKKFETLSYLGDADDAQSLEELQFRFRNEGSLAWI

SEQ ID NO: 28596 - protein, 628 aa, Oryza sativa
MAAPPLSSWPWASLGSYKYVLYGAVVWKVAEEWRQQGAAPVGSWWLHLLLLFAARGLTYQFWFSYGNMLFFTRRRRVVPDSVDFRQVDAEWDWDNFLLLQTLIGATLVGSPAVARQQLLLPSLKQAWDPRGWAIALLLHVLVAEPLFYWAHRALHRAPLFSRYHAAHHHASVTTPLTAGFGTPLESLLLTVVIGVPLAGAFLMGVGSVGLVYGHVLLFDFLRSMGYSNVEVISPRVFQAVPLLRYLIYTPTYLSLHHREKDSNFCLFMPIFDLLGGTLNHKSWELQKEVYLGKNDQAPDFVFLAHVVDIMASMHVPFVLRSCSSTPFANHFVLLPFWPVAFGFMLLMWCCSKTFLVSSYRLRGNLHQMWTVPRYGFQYFIPAAKKGINEQIELAILRADRMGVKVLSLAALNKNEALNGGGTLFVNKHPELRVRVVHGNTLTAAVILNEIPSNVKDVFLTGATSKLGRAIALYLCRKKIRVLMLTLSSERFLKIQREAPAEFQQYLVQVTKYQPAQNCKTWLVGKWLSPREQRWAPAGTHFHQFVVPPIIGFRRDCTYGKLAAMRLPKDVQGLGYCEYTMERGVVHACHAGGVVHFLEGWEHHEVGAIDVDRIDVVWKAALKHGLTPA

SEQ ID NO: 28597 - protein, 483 aa, Mycobacterium tuberculosis
MSSSESPAGIAQIGVTGLAVMGSNIARNFARHGYTVAVHNRSVAKTDALLKEHSSDGKFVRSETIPEFLAALEKPRRVLIMVKAGEATDAVINELADAMEPGDIIIDGGNALYTDTMRREKAMRERGLHFVGAGISGGEEGALNGPSIMPGGPAESYQSLGPLLEEISAHVDGVPCCTHIGPDGSGHFVKMVHNGIEYSDMQLIGEAYQLMRDGLGLTAPAIADVFTEWNNGDLDSYLVEITAEVLRQTDAKTGKPLVDVIVDRAEQKGTGRWTVKSALDLGVPVTGIAEAVFARALSGSVGQRSAASGLASGKLGEQPADPATFTEDVRQALYASKIVAYAQGFNQIQAGSAEFGWDITPGDLATIWRGGCIIRAKFLNHIKEAFDASPNLASLIVAPYFRGAVESAIDSWRRVVSTAAQLGIPTPGFSSALSYYDALRTARLPAALTQAQRDFFGAHTYGRIDEPGKFHTLWSSDRTEVPV

SEQ ID NO: 28598 - protein, 520 aa, Burkholderia mallei
MSPHPNSDNSTAQSNPPQLRRSLKARHLTMIAIGGSIGTGLFVASGASISQAGPGGAMLAYLLIGLMVYCLMMSLGEMAAFMPVSGSFATYGAKYVEEGFGFALGWNYWYNWAVTIAVELVAAQLVMHYWFPDVPGVWWSAAFLGVMFLLNVLTVRGFGEAEYWFALIKVVTVIAFIGVGLLMIFGILKGGPSNGWSNFTIGDAPFAGGLPAMMGVAMIAGFSFQGTELIGVAAGESENPRTTIPRAVRQVFWRILLFYVLAIFVIGVLIPYTDPNLLKSDVTDVGVSPFTLVFRHAGLAFAAGVMNAVILTAVLSAGNSGMYASTRMLHNLATEGRAPKLFAKLSAGGVPRNALYATTAVGALCFLSSLYGDKTVYLWLLNTSGMTGFIAWLGIALSHYRFRKGYVRQGFSVDQLPYQSSLYPYGPIFAFALCIVIALGQDYQAFLANRIDWIGVLATYVGIPLFLVVWLGYRLVHKTRVVRYEDMDIASWVAEHERAAAHEAREAAAVRVPSSPEAAS

SEQ ID NO: 28599 - protein, 177 aa, Ceratodon purpureus
MAPPTVGTQAQAAPAMVPARVYSKDDEVLVKKSWDILKKDAQRNGINFFRKVFEIAPGAKSMYSFLRDSTIPFEENPKVKNHARYVFMMTGDAAVQLGEKGAYQVLDSKLQKLAATHINAGVTDDQFEIVKEAILYAIEMGVPELWSPELKSAWGDAYDMLAAAVKAEMHAQRAAAQ

SEQ ID NO: 28600 - protein, 1382 aa, Oryza sativa
MPSRSPRGGGGVAAGAAFSRRQPMPSRSPRGGGGVAAGAAFSRRQPMPSRSPRGGGGVAIGAAFSRRQPMLTACRPHPRRERGEGKGSSWMLRSSTSPRRGPSTSPGRWASRWHSVDRRRRQAAQRQGGTVLHLRHVSALEPVRQYMDPYYSHYRNHAPYAHYPPSGCWEVSHPRMAMDSSCRPPSYGPWPNMNHLHPPEFHSCCNHTYPPGYYSFRLPSPQEIPPPHLYYHGPFPQHPNAYPSYFARPPPYPVDQTAYGYDKFKSHCCGCPNHSCHGGERSNIKIEEERPEVNPDTEQRDASGSDIVRHPNYQNQAIWLPSGNMNDKENKKSMELPPQFYNGWIPVSGKWVGDVKQQDQDDQKAKQFQWPIFWMPAGYNEKRQEAKELKEVDESPKVSEEAPPSPKIKIIPLSWFENGHNDQKPSVKDESHHNERSTVKKQSAGTEHQDGREMKNIPLMPKKESEEKMPARENYKTIPVMPRKDNEENKPAGGNYRIIPVMPVKESDDKKPEASVQRDEKKASSTEMEEENGKRSNEESSKAKNSKLPPVCLRVDPLPRKKSGSGSSRSPSPPTRKDADIAKKDVKEIHMQKQDAKQSDPKKERTVSEAKEKAHDEMNKGRAYGNETVQAASVKQMQEEQFPMSLADQKVQATGVNFDAQENVGEKNLQGSDKNTEGEAKIQGEPAKDYDTTPSINFSEVDAAVCIQSAYRGYNVRRWQPLEKLRMIKNVNEQMKDLKEQLQGIEASSKQLTVKEQVAINETIMNLLLKLDTIQGLHPTVREARKSVARELISLQEKLDCLCKQSSGESIHTNGEKEKPEAMENNFQNTDPVSAIEASEKEKAAGVDEEQGLSTINSKLLMPDAVSSVVSMYTTQDADPSDHIEESNTTKEEAPNNGGKVATQCDCQGEPSMDVMGDAALLGHSTEQKQQIEESNAISMDKSCEREKDVPPVGGQEIPSGDHMEPLHDEALSENSNELQQCTTSERSSTMISPAAADNSMITMAATSVESSVSADKVSPVEGQVTEAAVEHAPVEKDQCEEPNTTIVDSGDSSVSLKNEELQDHDQAPSGSSIMSNSAEQPEEASDVNMQQQVENVDTTQDATEESDATPEIGMVDVTYADTENYVQSPLLQTTSKLQSTTGQNVLKEPEAAKQSDVSGEYESVLVGKQNESANNLTGDSAKEEPPLVGLGMEADTHESAPRELKDEPILPETERSELSCEHGDITGHEDSEMYAPPECETDVQKESCCVDRRRADMQVPKEVECDELGDDNPKEDASVQTENMASEEASLASATPDGMKDENKVAEETTSDYATPYSSKSDNENKLAEENQKLKEMLQNLLASGSDQMGVITELSEKVKTLERKLARKKRPKDMWQGSGS

SEQ ID NO: 28601 - protein, 463 aa, Geobacter metallireducens
MTRILIVDDNEQNLYMLEVLLSAHGFQALSATNGAEALALAQASPPDLIISDILMPVMDGYAFCRECKKTAQLNDVPFIFYTATFTEAEDEKLALSLGADRFLLKPQEPDEMMRIVRELLAVPRPGTGREPSEKGQEQAEHLQKYGEALFRKLEKRMADLKQANRALEHEIEERKKAELELQQVNRTLEERVAERTALLAAANGQLQEEVQRSRQAQNEIALLNDVLVRRTESLEGLNRELEAFSSAVTHDLQAPLRSIIGYAGIVREECENAVDGSVLEYIGRIERSVNRMNELIEALRDLSQASSAALHPDTVNLSTIVREIISALQEADSERRVTFVIADGVTAEADRPLITSVIDNLLNNAWKYSRRNETARIEFGALEKDQEHVYFVRDNGAGFDMKYASKLFTPFQRLHRQDEFEGTGVGLATVQRIIHRHGGRIWAEAKVAEGATFYFTLSRAMHG

SEQ ID NO: 28602 - protein, 293 aa, Ashbya gossypii
MSDEITHPTIKDGWFREISDTMWPGQAMTLRVEKVLHHEKSKYQDVLVFKSTNHGNVLVLDNVVQCSERDEFAYQEMITHLAMNLHANPKKVLVIGGGDGGVLREVLKHESVEEAWLCDIDEAVIRVSKQYLPEMSRSYEHPKVKTHIGDGFQFLRDYPNTFDVIITDSSDPEGPAEALFEQPYFSLLNQALTENGVITTHPESLFIHMEIIKQLKGTCSQLFPNVGYAYASVPTYPSGQIGFMVCSKNADIELSKPLRTISDEQERELYKYYSKKMHEACFVLPTFAAKELN

SEQ ID NO: 28603 - protein, 705 aa, Unknown
  Candidatus Kuenenia stuttgartiensis
MAQFKVEKLIGNRALSIETGRVARQADGAVLVQYGETIVLVTAVSASEEKGNVDFLPLTVDYREKTYAAGKFPGGFFKREGRPSQKEILTMRLIDRPIRPLFPDTYFREVQVMSIVLSADKENDPDILAMVGASAALSISSIPFCKPTGSVRVGQIEEKFIINPTHAELAQSSMDIVISGTEDAVMMVEASAKEIPEEQMVDAIMFGHAAIKEIITLQHELIEKCGKEKQIVAPSRMNKELMEEIKQKYYTAIVEKNLTPGKGYRKEALDEILAAIINEYCVEGVEDAPTPKEIKAIFETVETIVVREQIVSKGLRPDSRGLKDIRPITCEVGILPRVHGSALFTRGETQAIVVVTLGTTSDEQKVDGLEDEYSKKFMLDYNFPPFCVGETKPLRGPGRREIGHGALAERALAEVLPPPNKFPYTTRVVSDITESNGSSSMASVCGGTLALMDAGVPIKAPVAGIAMGLVKEENSVCILSDILGTEDHLGDMDFKVAGTAQGVTALQMDIKIAGITEKIMRDALAQAREGRLHILQELEKVIEKPREKISVYAPKIVQIKINPEKIGMIIGPGGKNIKKIQEETGAKIEIEDDGTVIISATLGESAEKAKTWIENMTKEVEVGKTYKGKVLSIKEYGAFVEIIPGHDGLVHISELSYEYVEKAGDVVEVGQEIMIKVIGIDDQKRVKLSRKAALKESEQPLTPKN

SEQ ID NO: 28604 - protein, 241 aa, Zea mays
MAMLREHLDLIRAHLLDDNHDAVSSDDSAPSPSPSPPGRRPLPALSVSLPPRPAVVLQQQHLRAAAPPLQIPQQEQHCCPEPEEDDFRRYRGVRQRPWGKYAAEIRDPARKGARVWLGTYDTAVEAARAYDRAAFRLRGSKAILNFPNEVALSTAAWWATPAPPPQPSATVAGNKRARSPQEQDARCMVREVKKERIQEPASGGADYFWEDESLKGAICSLPPLSPLSPHPHLAVPQLYVS

SEQ ID NO: 28605 - protein, 461 aa, Streptomyces coelicolor
MPAVPERAPVTTRSETQSTLDHLLTEIELRNPAQPEFHQAAHEVLETLAPVVAARPEYAEPGLIERLVEPERQVMFRVPWQDDQGRVRVNRGFRVEFNSALGPYKGGLRFHPSVNLGVIKFLGFEQIFKNALTGLGIGGGKGGSDFDPHGRSDAEVMRFCQSFMTELYRHIGEHTDVPAGDIGVGGREIGYLFGQYRRITNRWESGVLTGKGQGWGGSLIRPEATGYGNVLFAAAMLRERGEDLEGQTAVVSGSGNVAIYTIEKLTALGANAVTCSDSSGYVVDEKGIDLDLLKQIKEVERGRVDAYAERRGASARFVPGGSVWDVPADLALPSATQNELDENAAATLVRNGVKAVSEGANMPTTPEAVHLLQKAGVAFGPGKAANAGGVAVSALEMAQNHARTSWTAARVEEELADIMTSIHTTCHETAERYDAPGDYVTGANIAGFERVADAMLAQGVI

SEQ ID NO: 28606 - protein, 628 aa, Bordetella bronchiseptica
MCGVLGAWWRHHDEHEDARFAAGLRKLAHRGPDDRGSEHFAAPHGRLSLGHTRLAVIDLSAAGHQPMHADADRLAVVFNGEIYNYRELRSELRQIGAIFRGDSDTEVLLAAWQHWGVAALRRFKGMFAFALYDRRQQTLTLARDAFGIKPMYYHAAPERLLFGSELPAVQALLPHPPRLNWQRAYDYLAYGQYDQPPDTFIAGIRQLPAGHLLTLDLRTGRAGEPMAWDDPASQECRPIGFQEAAEELRARFLDNVRLHLRSDVPIGAALSGGIDSSAIVCAMRWLEPDLPIQTFSFISDDTHRSEERWVDLVNQHCGATGHKIHIAPHELLDDLDDLIRVQGEPVGSTSIYAQYRVFKLAREHGVVVTLDGQGADELLGGYGGYPTERLASLLETGRLGAAARLLRQQGRGAPARLLQAAALAAGGRHLANLRHATGRQHAPAWLDAQVLRDQGVTMREPAHAWAAATPLRGRRLVNELAHALYHRGLGALLRHGDRNSMRFSVESRVPFLTQDLAEFALSLPERYLVSDAGQTKHIFRKAMRGIVPDSILDRDDKIGFATPEQQWMQATAPQMRQWLVDAADIPFLRNAEVTAQFDAMIAGATPFSWQAWRWVNFQRWMQHATVLP

SEQ ID NO: 28607 - protein, 335 aa, Aspergillus nidulans
MPRAEAGSTKALSNKLKAKGLGRLRWYCQACERQMRDENGFKCHVQSESHVRQVLLIGEDPKRYIEDFSRQFIKNFLDLLRTTHGEKKVHINQFYQQVIADKEHIHMNATKWKSLTQFAAHLGREGLCHVEETEKGLFVSYIDRSPEAMRRREAIMKKERQDRGDEEREQRLIQEQVERARAKEKEEEIGPEARNLQRKEGEKVKLNIGFGAKATPPASTEQSRTQSPDEKEKDKDKESSSATPESSATASPAPSQNPQAAPKVSMSLGGGNSKPKNVFASAAKKNPLAGKKATVVAPPKKMSEQERIMKQEMEAMERKRLGGGGMPNSKRPKVS

SEQ ID NO: 28608 - protein, 186 aa, Unknown
  Azoarcus sp. BH72
MTNTTDTSLQTALLGGGCFWCLEAVFREVEGVERVVSGYSGGHVEAPTYRQVCAGGTGHVEVVQIHFDPARVSYRDLLEIFFVIHDPTTMDRQGNDIGPQYRSVIYVNGDEQLHTALALIEELGEARVYPRAIATRVERAGTFWPAEVEHQEYYAHNSDQPYCQYVVAPKVAKFREKFAARRKGGR

SEQ ID NO: 28609 - protein, 369 aa, Leifsonia xyli
MIGAGSWGTTFAKILADGGNDVVVWARRPELAREIDEGKRNSDYLQGINLPRSLRATSHLGEAMRGAEQVFVSLPSQTLRSNLDAMIPYLGPATVVISLMKGVEKGTGLRMSEVIAQGLPIDPEQIAVVSGPNLALEIAREQPTAAVVSSVSPATAVAVATSATNRYFRSFVNTDVIGTEFGGVLKNLIAVAIGIVDGVGYGENTKASIITRGLVEMTDFAVAYGADPQTLSGLAGLGDLIATCESPLSRNNTAGRLLGQGYSFTDVVKQMDQAAEGLASVTPILSLAEARGVEMPIVRQVSQVLAGTLAPKDIAPHLTTDDEPQGERTRGERTTDDGQGQGRTSVWGSLKRAFDQLRDGGGSSRRDRP

SEQ ID NO: 28610 - protein, 538 aa, Haloarcula marismortui
MIHRTLSEVQTRLVKFGIVCLGTVLIAAAPTPAGLSLAGQYTLATMFFAGTLWVTGTLPLAVTALSIPVLLTATGVYDDMDTALVGFADHLIFLFMAGFMLANALQKYDIDRRIALYTMARMGSSPRRLIGAVMISTAGLSMWVSNTATAAMMTPIAVGVLSQVLSSEGVAAVGESTPEGAASGTATDGGIGTADEFTNMQIGMLLGTAYAASIGGVGTIIGTPPNAVLVGQLNAILGYEIGFVDWLLIGLPVVFITLPLVWYLLTYVLYPPQINNVDEAQAQAQAYLDDEDSLDPRGRRVAIIFGATAGLWVLGGLGTFLAPYLPAVWLTTLFGGSGMTIFGLEGHQGLLYYVMVGVMAIPALVLADTMEWDELVDIDWGTLLLFGGGISLADALANTGTTEWIANTVFGGLTGMPVVLIIAAVVLVVVFLTEMTSNTATTTILVPILIGLGSVFAATLGLTDFKTAIFLSVSGAIAASFAFALPVATPPNAIVYGSGYIKQSHMLRTGVILNIVMTAVLTGLIWLLFTFVWPHLLW

SEQ ID NO: 28611 - protein, 366 aa, Unknown
  Oceanospirillum sp. MED92
MSDTNFYTLKIAEVQPETDTAIAVSFAVPAELQDKFNFIQGQFLTLRAEIDGEDVRRSYSICSGVNDGHMRVGIKRVKDGKFSNYANDNFKPGMSVEVMPPQGSFFTEVKADQKKNYMCIAAGSGITPMISIMKTVLSTEPESKVTLIYGNRRSNTVMFKDELNFVKNRYLDRFQWINIMDYEDQGADLLNGRIDNAKGYALQKSGLINIKEVDEAFICGPEAMMSEVSRGFRMEGLTDEHIHYELFASSATDSKAMLEKAAARKEQFGEEKMSKVTVMADGRSVMFDLATVGENILDAGIENGMDLPYSCKGGVCSTCKCKLVKGEVDMDISHGLEQHEIDAGYVLSCQAHPISDEVVLDFDARS

SEQ ID NO: 28612 - protein, 130 aa, Glycine max
  misc_feature (116)..(116): Xaa can be any naturally occurring amino acid
TCSAHAFADAALKMIIYLRVDDGNTITAATDETATLPDDDSPSQDIAEGKPVSFRDTSLARDVYSAITAGSHGKSPYLTHPSFNTCQTEHDLLRDLCRLSSSHLSLCRQWIPLGSXTMKLNATSDMMPET

SEQ ID NO: 28613 - protein, 917 aa, Arabidopsis thaliana
MATSVDNRHYPTMNGVAHAFKPPLVPSPRSFDRHRHQNQTLDVILTETKIVKETEVITTVVDSYDDSSSDDEDESHNRNVPYYKELVKKSNSDLEPSILDPRDESTADSWIQRNSSMLRLTGKHPFNAEAPLPRLMHHGFITPVPLHYVRNHGAVPKANWSDWSIEITGLVKRPAKFTMEELISEFPSREFPVTLVCAGNRRKEQNMVKQTIGFNWGSAGVSTSLWKGIPLSEILRRCGIYSRRGGALNVCFEGAEDLPGGGGSKYGTSIKKEMAMDPARDIILAYMQNGELLTPDHGFPVRVIVPGFIGGRMVKWLKRIIVTPQESDSYYHYKDNRVLPSLVDAELANSEAWWYKPEYIINELNINSVITTPGHAEILPINAFTTQKPYTLKGYAYSGGGKKVTRVEVTLDGGDTWSVCELDHQEKPNKYGKFWCWCFWSLDVEVLDLLSAKDVAVRAWDESFNTQPDKLIWNLMGMMNNCWFRIRTNVCKPHRGEIGIVFEHPTRPGNQSGGWMAKERQLEISSESNNTLKKSVSSPFMNTASKMYSISEVRKHNTADSAWIIVHGHIYDCTRFLKDHPGGTDSILINAGTDCTEEFEAIHSDKAKKLLEDYRIGELITTGYDSSPNVSVHGASNFGPLLAPIKELTPQKNIALVNPREKIPVRLIEKTSISHDVRKFRFALPSEDQQLGLPVGKHVFVCANINDKLCLRAYTPTSAIDAVGHIDLVVKVYFKDVHPRFPNGGLMSQHLDSLPIGSMIDIKGPLGHIEYKGKGNFLVSGKPKFAKKLAMLAGGTGITPIYQIIQSILSDPEDETEMYVVYANRTEDDILVREELEGWASKHKERLKIWYVVEIAKEGWSYSTGFITEAVLREHIPEGLEGESLALACGPPPMIQFALQPNLEKMGYNVKEDLLIF

SEQ ID NO: 28614 - protein, 692 aa, Clostridium perfringens
MKRIQSTCNYCALACNLDFYTEDGKIKRVVPTPHYPVNKGFSCIKGLNLDKQCTKFNGSKKPLLKMKDGERKAIEWKEAFDLFASKMTAIQEKYGKESVAYISTGQLPTEEMALLGHVGRSYMGINGDGNTRLCMASAVVAYKQSFGFDAPPYTLKDLELSDTIFFIGANPVIAHPIAWGRVRKNKDAKIITIDPRKSETAMNSDMWIDIKTKGDLALFYTLANVLIEKGWINQDYINNYTEGFEDFKAHVKKYTLEDVEERTGISKMRVLELAKIIHEGKRVSFWWTMGVNQSYEAVRTAQAIINLALITGNMGREGTGANSLTGQCNAMGSRMFSNTTALYGGGEYNNKERRKVVADILGMDENMLPTKPTLDYEQIIKGINKGEIKGLWVVCTNPRHSFSNNEEFKKAMKNLDFFVVQDIYEDTDSSKECDLYLPSVPAIKKEGFLINTERRLSALVPVLEKEEDELSDYEILLGIGEALGMGSLLDKWRTPEDAFKLLRECSKGMPCDITGVSYERLRDSKGIQWPCRKGEELESDERRLFEDGKYYTPSGKAKFIFEDVTENPNATNEEFPFNLNTGRGTVGQWHTHTRTREIQAVTNIVSQKAYVDINRKDAEKLDIKENDEVLIHSSNGHTSKFIARLTDNLKEKTLYAPIHYIETNLLTPSVFDPYSKEPSYKTVQVNIEKVRK

SEQ ID NO: 28615 - protein, 131 aa, Unknown
  Mycobacterium sp. MCS
MTQPTRSFYDEVGGHETFRAIVARFYELVREDEILRPLYPDDELEAAEVRLRMFLEQYWGGPRTYSDQRGHPRLRMRHAPFRIGYIERDAWLRCMHTAVAEIDAVTLDDEHRRELLAYLEMAAQSMVNSPF

SEQ ID NO: 28616 - protein, 184 aa, Arabidopsis thaliana
MEETTTFHGLGHLFITIFLYCFSSFIVAPVITDISMAALCPGKDECSLAIYLSGFQQVITGVGSLIMMPLVGSLSDKHGRKCLLTLPMTLNILPLVTLAYSRGATIFYMYYVLKTLTSIVCEGSVLCLALAYVADNVPEGRRASAFGILTGITSCAFVCANLSARFLSIGVTFQQQWEFYQRCI

SEQ ID NO: 28617 - protein, 112 aa, Corynebacterium efficiens
MKLITAIVKPFTLTDVKEALEQVGVQGMTVTETQGFGQQKGHTEVYRGAEYAVDFVPKIKIEVVVSDAQLDEVVEAIVTTARTGKMGDGKVWVTHVEELIRVRTGERGDEAL

SEQ ID NO: 28618 - protein, 708 aa, Nitrosomonas europaea
MKPIKKSITYGRHTLTIETGEIAKQAHGAVIVSMDDTVVLVTAVGDKKTKPGQDFFPLTVDYQEKFYSAGRIPGSFFKREGRPSEKETLTSRLIDRPIRPLFPDGFYNEVQVVAMVLSSDTEIDADIPAMIGTSAALILSGIPFDGPVGAARVGYINNEYILNPTTTQLKESQLNLVVAGTQKAVLMVESEADELSEDVMLGAVTYGHDQMQQVIDMINELADEAGVTAWDWQPAEQDLSLVEKVTQLAEADLRNAFRLKQKSARVEAINEIWQRVFTELKVGTEEGPSEQAVREIGFALEARIVRNSILDGESRIDGRGTRTVRPITIRHGVLPRTHGSALFTRGETQALAITTLGTARDEQKIDALQGDYSERFMLHYNMPPFATGETGRVGTPKRREIGHGRLAKRALLAVIPPVEEFGYSMRVVSEVTESNGSSSMASVCGGCLSLMDAGVPLKAHVAGIAMGLIKEGNRFAVLTDILGDEDHLGDMDFKVAGTEHGITALQMDIKIQGITKEIMQVALLQAKEGRLHILEIMKQSLPIARESISVHAPRIIKFKINPEKIRDVIGKGGAVIRALTEETGTTIDISDDGSVTIACVSSEGGEQARKRIEDITADVEVGRIYEGTVLKLLDFGAIVSVLPGKDGLLHISQIANERVENVADHLKEGQTVRVKVLEADEKGRLRLSMKAASISTEITADNPDNTEK

SEQ ID NO: 28619 - protein, 337 aa, Anabaena variabilis
MELGMIGLGRMGANMAHRLTQAGHTVIGYTRQPQKAEVLVQEGAIARGVTSFVELIEALTPPRTVWLMLPAATVDATLQTLIPFLDADDIIIDGGNSYYIDDIRRADQLKVKGIEYIDCGTSGGIWGAERGYCLMIGGALAVVKYLDPIFAALAPGVSAAPRTPGRELMGGTAEQGYLHCGSHGAGHFVKMVHNGIEYGIMAAYAEGLNILHHANIGKQLHQVDAETAPLRNPEFYQYDFNLADIAEVWRRGSVISSWLLDLIAMALVKDPDLTDFGGRVSDSGEGRWTLMAAIEEAVPTPVLSTALYTRFSSRGQSEFANKLISALRYEFGGHLEK

SEQ ID NO: 28620 - protein, 389 aa, Unknown
  Rhodococcus sp. RHA1
MSQQEWLDRDFYAVLGVPSTASAEEIKKAYRTLARELHPDANPHNTEVEERFKKVSEAYAVLSDPAKRKDYDRVRRLLRSGGFPGTGFPPGTGSGGFDFGDLFGSGSPFTIGDPLGGVGDVLGDLFRRAGTRTASARPKRGSDVETETRLSFREAVAGMVLPLLMTGPMVCTSCHGSGTRPGTRQRTCPHCRGVGVRNRNLGGFGFSEPCEDCRGTGSIVDTPCPDCQGAGIGDRTRTISVRVPPGVSDGQRIRLPAQGEPGLGGAPSGDLYVTVRVEPDPVFARSGDDLTVTVPVSFAELALGTVLSVPNFDGRVSLKIPPGTQSGRTFRLRGRGVPRRGDAVGDLLVTVEVAVPSDLGHEAAEALRAYARAEEMGGFDPRSGWADSR

SEQ ID NO: 28621 - protein, 151 aa, Schizosaccharomyces pombe
IGGAQESLLSRPGQNNLVLKKRFGFVKLAFLTGSSLVPCFAFGESDIFEQVDNNPRTRIYKFQEIVKKIAGFTVPFFYGRGLLNKTFGLMPWRKPINIVVGEPIDVPKKSHPTNQEIYEVHEEYIRRLEGLWNKYKDVFLPNRISELKLSA

SEQ ID NO: 28622 - protein, 585 aa, Glycine max
MKQEMEKRKGGRIEESDEEKWVHDASVDYKGRIPLRASTGVWKASLFVLAIEFSERIAHFGISSNLIMYLTEVMHEDLKTATNNANLWKGATTLLPMIGGFLGDAYTGRFRMVVFSSLVYFKGLSLLTMSQFIPNLKPCNNDICHQPRKVHEVVFFLALYCIALGTGGFKPCLESFGGDQFDGDNLEERKKKMSFFNWWTFTFSIALLLATTVVVYVQDFVSWGVAYLILAMFMALTIIAFYVGIPFYRYRMRPNANPFIPILQVLIASIRKRNLSCPSNPALLCEVPMSENSQGRLLNHTSRLRFLDKAAIVEEKYIEKKAGPWRLATVTRVEETKLILNVVPIWLTSLMIGVCIAQGSTLFVKQAAAMNLKISDNFKIPPASMASLSAFSTIISVPIYDRIIVPILRKVRGNERGISILGRIGIGLIFLVILMVVAALVENMRLRMPGHETMSVMWLIPQYLILGIGNSFYLIALQEYFYDEVPDSMRSVGMALYLSVIGIGFFLSSFLIIIVDHVTGKNGKGWIAKDVNSSRLDKFYWMLAVISALNLCLFLFLAKRFTYKTARRKATEIDCSNCDGVDTVA

SEQ ID NO: 28623 - protein, 395 aa, Corynebacterium efficiens
MNNAEWANKDYYADLGVSKNASAEDIKKAYRKLARENHPDKNPGDKVAEDRFKKAAEAYDVVGDETKRREYDDLKKLLASGGIRGGFGSGGADFPGGFRSTQGFDASDLFGGAGPGGGFSADGGLGDIFGGIFNRGSSPRQSARPTRGADVETDITLEFREAAKGTTIPVELTGEAPCNTCHGSGSASGQPSKCGQCNGSGFTSENKGAFGFSAPCTNCGGTGEVITDPCVDCRGRGTVRRTRSITVRIPAGVEDGQKVRLAGQGEAGPNGKPAGDLFVRVHVKEDPVFEREGNNIHVTVPVSFSELALGGAISVPTLDKPVKLKLAPGTPDGRTLRVRGRGVETRTAKGDLMVTVQVTVPPTLSDEAAEALRTYAEAEKKSGFDPRANWAGNNR

SEQ ID NO: 28624 - protein, 178 aa, Brassica napus
TSRSSSVSSRRRRSRRLPRAAVAMGRRPARCYRQIKNKPYPKSRYCRGVPDPKIRIYDVGMKKKGVDEFSHCVHLVSWEKENVSSEALEAARIACNKYMTKHAGKDAFHLRVRVHPFHVLRINKMLSCAGADRLQTGMRGAFGKPQGVCARVAIGQVLLSVRCKPNNAIHATEALRRA

SEQ ID NO: 28625 - protein, 390 aa, Unknown
  Candidatus Pelagibacter ubique HTCC1002
MIKNLSKPFKWFFQLEAASGLVLLIAAIIALVISNSSLSNLYFDTLNQYLFIGINDFGLKLSVHHWINDLLMAIFFFFVTLEIKREFIQGELSNLKKALLPIIGAVGGMVVPALVYVFINLGNSETLNGWAIPSATDIAFSLGILSLLGSRVPISLKVFLTALAIIDDLGAILIIAFFYSGDLSISYLSLILISYILLLTLNKFGVKKFIPYLIIGAFMWFFTYKSGIHATIAGVLLASTIPHRIKEKDFSLLIKLEHAISPYVAFIIMPIFAFANAGVSLEGLSLTSLLEPVPLGILLGLFVGKQVGVMVVSFIAVKFGVAQMPDKSSWLSLYGVSILTGVGFTMSLFVGNLAFAENIQYIDGVKIGVLAGSLLSTVFGYFILLYASKK

SEQ ID NO: 28626 - protein, 790 aa, Triticum aestivum
MTMMAMAKAPCLCARPSLAARARRPGPGPAPRLRRWRPNATAGKGVGEVCAAVVEAATKAEDEGEEDEPVAEDRYALGGACRVLAGMPAPLGATALAGGVNFAVYSGGATAAALCLFTPEDLKADRVTEEVPLDPLMNRTGNVWHVFIEGELHNMLYGYRFDGTFAPHCGHYLDVSNVVVDPYAKAVISRGEYGVPARGNNCWPQMAGMIPLPYSTFDWEGDLPLRYPQKDLVIYEMHLRGFTKHDSSNVEHPGTFIGAVSKLDYLKELGVNCIELMPCHEFNELEYSTSSSKMNFWGYSTINFFSPMTRYTSGGIKNCGRDAINEFKTFVREAHKRGIEVILDVVFNHTAEGNENGPILSFRGVDNTTYYMLAPKGEFYNYSGCGNTFNCNHPVVRQFIVDCLRYWVTEMHVDGFRFDLASIMTRGSSLWDPVNVYGAPIEGDMITTGTPLVTPPLIDMISNDPILGGVKLIAEAWDAGGLYQVGQFPHWNVWSEWNGKYRDIVRQFIKGTDGFAGGFAECLCGSPHLYQAGGRKPWHSINFVCAHDGFTLADLVTYNNKYNLPNGENNRDGENHNLSWNCGEEGEFARLSVKRLRKRQMRNFFVCLMVSQGVPMFYMGDEYGHTKGGNNNTYCHDSYVNYFRWDKKEQYSDLHRFCCLMTKFRKECEGLGLEDFPTAERLQWHGHQPGKPDWSENSRFVAFSMKDERQGEIYVAFNTSHLPAVVELPERAGRRWEPVVDTGKPAPYDFLTDDLPDRALTIHQFSHFLNSNLYPMLSYSSVILVLRPDV

SEQ ID NO: 28627 - protein, 112 aa, Unknown
  Acidovorax sp. JS42
MKMVTAIIKPFKLDEVRESLSDIGVQGITVTEVKGFGRQKGHTELYRGAEYVVDFLPKVKIEAAVADELVERVIEAIEGAARTGKIGDGKIFVAHLEQVVRIRTGETGQEAL

SEQ ID NO: 28628 - protein, 999 aa, Ralstonia solanacearum
MLLTRKPAAQDAKTGQASRPGAATLSGSLARGLAGALPTMDRRTFLKRSGIGVGAGLAASQLSLVKKATVVGEARAAEGKDDIVVRRTVCSHCSVGCAVDAVVQNGVWVRQEPVFDSPINMGAHCAKGAALREHGHGEYRLKTPMKLVDGRYQRISWEQALNEIVARMNAIRQETGPDSFFFVGSSKHSNEQSYLLRKWVSFFGTNNCDHQARICHSTTVAGVANTWGYGAMTNSYNDMQNAKCALYIGSNAAEAHPVSMLHLLHAKETGCKVIVVDPRYTRTAAKSDEYVRIRSGTDIAFLFGVLHHVFKNGWEDRQFIHDRVYGMDKVRDEVLAKWTPDKVEAVCGVPEAQVRKVAEMMAMNRPSTLVWCMGQTQHTIGNAIVRASCIVQLALGNIGRPGGGANIFRGHDNVQGATDVGPNPDSLPGYYGLAAGAWKHYAAVWGVDYDWIKGRFASQAMMEKSGTTVSRWIDAVLEKNELIDQDHNVRAMFYWGHAPNSQTRGLEMKRALDKLDLLVVIDPYPSATAAMANMPAADGTPPNPNRAVYLLPAATQFETSGSCTASNRSLQWREKVIEPLFESQPDHVIMQALADRLGFGNELSKRLKVTEYKRAGMTWREPGTESILREINRSNWTIGYTGQSPERLQAHMRNMHLFDVRTLRCQGGKDPVTGYDLTGDYFGLPWPCYGTPELKHPGSPNLYDTSKHVMDGGGNFRANFGVERDGVNLLAEDGSYSLGAELTTGYPEFDHVFLKKLGWWDDLTDVEKKAAEGKNWKTDLSGGIQRVAMKHGCHPFGNAKARAVVWNFPDPIPQHREPLYSTRPDMVAQYPTHDDKKAFWRLPTLYKTVQQRNIENKVYEKFPIILTSGRLVEYEGGGEETRSNPWLAELQQENFVEINPKAAADRGIRNNDYVWVKTPTGAQIKVRALVTERVGVDHAFIPFHFSGWWQGKDLLDYYPEGAHPIVRGEAVNTATTYGYDSVTMMQETKTTVCQIERFA

SEQ ID NO: 28629 - protein, 376 aa, Unknown
  Nostoc sp. PCC 7120
MARDYYEILGVARDADKEEIKQAYRRLARKYHPDVNKEPGAEERFKEINRAYEVLSEPETRARYDRFGPEGVSGAGVGFQDMSDMGGFADIFESIFSGFAGGGMGGPTQQRRRGGPARGDDLRLDLKLDFREAVFGGEKEIRISHLETCETCSGSGAKPGTRPRTCSTCSGSGQVRRVTRTPFGSFTQVSTCPTCNGTGMVIEDKCDTCDGKGTNQVTKKLKITIPAGVDNGTRLRIKDEGDAGQRGGPPGDLYVYLFVNEDEEFQRDGINVISEIKVSYLQAILGCRLEVNTVDGPVELIIPAGTQPNTVMKLENRGVPRLGNPVSRGDHLLTVLIDIPTKVIPEERELLEKLAKIKGDRTGKGGLEGFLGNLFK

SEQ ID NO: 28630 - protein, 113 aa, Unknown
  Oceanobacter sp. RED65
KHELVTAVIKPFKLDDVREALSEIGVQGITVTEVKGFGRQKGHTELYRGAEYVVDFLPKVKLEIAIDEAQLDKVIEAITEAANTGKIGDGKIFVTNLEQIIRIRTGETGADAV

SEQ ID NO: 28631 - protein, 554 aa, Geobacter sulfurreducens
MQVLLAYKSHHAGARDPFASLLPTGLGYLNGLLRAQGFASRIANLSTMGWREVDALLRRERPTILGISQYTHNRFESLRLVSSAKTADPTCLTVLGGPHATHSFDMILQHHPQVDAVVLGEGEETMLELVRTVAEGNRSLAGIPGLAIREGSGISHSSRAPLRNLDDLPVPARYFDNALGCDLRRQLEFVITSRGCPASCRFCSSPRFWGTSLRLRSPRAMVDEIRYIRDRFGLLSFSLRDDTFTARADRVIEFCRLLTAEGLHILWSCQSRVNCVDEEMLLWMRRAGCEYVQYGVESGSERILARLGKRITPDQVQRAAAATRRAGMDLSIYLIAGVPGEDEEDLRATLRLIEDIRPHDGHVAPLAYYPGTALFAEAVREGRVPADLFEREKGEACFVRKDATVQRSIDRLLTTLARVGRKARFGPADFARQAKLVGWCHAGALAEGGWYEEREEWREAEACYRQITHRQPANPWGWLALGGLHGSVGDLEQSRQMFTRVLELVPAHIPAHLALGDLCLHDGDRRGARRNYEAALTLNPGDVEARERLKELKE

SEQ ID NO: 28632 - protein, 546 aa, Thinopyrum intermedium
MGLDLGELAFRYTGLAVSDHDSIVAINIFIALLCGCIVFGHLLEGNRWVNESTTALVLGLITGGVILLCTKGVNSRILIFSEDIFFIYLLPPIIFNAGFQVKKKQFFRNFATIILFGAAGTLISFVIITFGAMGLFSKLDVGPLELGDYLAIGAIFSATDSVCTLQVLNQDEAPLLYSLVFGEGVVNDATSVVLFNAIQNIDINHFDVFVLLQFIGKFLYLFFTSTVLGVASGLLSAYIIKKLCFARHSTDREVAIMILMAYLSYMLSMLLDLSGILTVFFCGIVMSHYTWHNVTESSRVTTKHTFATLSFIAEIFLFLYVGMDALDIDKWKLASSSPKKPIALSAVILGLVMVGRAAFVFPLSFLSNLSKKESHPKISFNQQVIIWWAGLMRGAVSIALAYNKFTTSGHTAVRVNAVMITSTIIVVLFSTMVFGLLTKPLINLLVPPRTGTAADISSQSFIDPLTASLLGSDFDVGQLTPQTNLQFLLTMPTRSVHRVWRKFDDKFMRPMFGGRGFVPFVPGSPIERSVHGPGLLGTATEAENRS

SEQ ID NO: 28633 - protein, 222 aa, Brassica napus
  misc_feature (166)..(166): Xaa can be any naturally occurring amino acid
  misc_feature (193)..(193): Xaa can be any naturally occurring amino acid
  misc_feature (212)..(212): Xaa can be any naturally occurring amino acid
MGKGPLSFRRLSSIRRRKKGSSVKDDPNQSSNPSSPPPPSPINAGGSVAAGTTGKVKKKAGGARLWMRFDRTGAMEVVECDKSTIIKRSSVPARDLRILGPVFSHSSNILAREKAIVVNLEVIKAIVTAEEVLLLDPLRPEVLPFIDRLKQQFPQRNALEATPNVXTFDPEAGEGLQSELPFEFQVLEMALEXVCSIVDTSVASLETDAWPXLDELTKNVST

SEQ ID NO: 28634 - protein, 313 aa, Prosthecochloris aestuarii
METLHCDVAIIGGGPAGCSAAIYTARADLDTVIIDKDPHAGALGMAHIIANYPGMGNDITGMELLESMRRHAGSFGARFMKQKVNGIDVRNPEKTVFTTSGTMFKAKALILATGSMGKSRELPGEKELLGAGVSYCATCDAAFYRQKVVAVAGRTREAVEEALVLSRFASKVYLFCPTASLTAPPEDIHMLQEQKNIEVFYSRRLDAINGGKFVESVTLGAPEEVVAVDGVFLYLTGSAPVLDFTGGQLDVCQSGCLQVDKDFMTSVPGVFAAGDILCKEVKQAVIVASEGCRAALQVDKFLRGRDRARSDYQ

SEQ ID NO: 28635 - protein, 946 aa, Herminiimonas arsenicoxydans
MNAITRSEMALLDVPTVTFELNGREVTGRATDTILTVAKREGIEIPHLCFKEGMDTAGNCRACVVEINGERVLAPSCCRNPTNGMKVNTESERAVKSQKLVLELLQSDMPETDYTRHNEVDEWAAKMEVGKPRFEARARVAPDFSHPAMTVNLDACIQCTRCVRACRDEQENDVIGLAFRGDHAKIVFDMDDPMGASTCVACGECVQACPTGALMPARDVGMNVPDKQVDSVCPYCGVGCQLTYNIKDNKILYVEGRDGPANRERLCVKGRYGFDYANHPHRLTKPLIRRADAPKRGDFVMDPDRVMEVFREATWEEALEVAGGNFAKIRDTHGKKSLAGFGSAKGSNEEAYLFQKLVRTGFGSNNVDHCTRLCHASSVVALLEGIGSGAVSNPVMDVTKAEVVIIIGANPTVNHPVAATWIKNAVSNGTKLIVCDPRRTDMARIAHRFMQFKADTDVAMLNAMMNVIVTEGLVDKEFIESRTIGYEELRKNVEGYTPELMAPICGIDAETLRYVARLYATSKASMILWGMGVSQHIHGTDNARCLIALSLMTGQIGRPGTGLHPLRGQNNVQGASDAGLIPMVYPDYQSVSDPKIRANFAKAWNMSVDLLDPEPGLTVVEIMHAITDGKIRGLYVQGENPAMSDPDANHAREALAALDHLVVQDIFLTETAYLADVILPASAFPEKTGTFTNTDRTVQMGRQALNPPGEAKQDLWIIQQMANRLGCNWNYKHVSEVFDEMRHTMPSIAGITWERLEREDSVTYPCEKEGDPGEPVVFVDSFPRESGRARFVPADIIPAAERPDTEYPMVLITGRQLEHWHTGSMTRRATVLDSIEPDPIALIHPLDLANMGGKPGDIITLESRRGEVSLYARADDSSPRGAVFVPFCYYEAAINRLTNAALDPFGKIPEFKYCAIRIHLGGAAPVQTSYGGGQALENLTNSLTLN

SEQ ID NO: 28636 - protein, 318 aa, Idiomarina baltica
MAEAKHCKLLILGSGPAGYTAAVYAARANLDPVLVTGMQQGGQLTTTTDVENWPGDAEGLTGPDLMVRMQQHAERFDTEIVFDHINKVDFSERPFRLKGDVGEYTADSVIISTGASAKYLGLDSEEAFMGKGVSACATCDGFFYKNQKVCVVGGGNTAVEEALYLSNIASEVHVIHRRDTFRSEKILSDRLMEKAENGNVTLHLNKTLDEVLGDDSGVTGVRIKDTKDGSTSELDVAGCFIAIGHQPNTGLFDGQLEMNNGYIVVQSGLEGNATATSIPGVFAAGDVMDHVYRQAITSAGTGCMAALDAERYLDALTK

SEQ ID NO: 28637 - protein, 255 aa, Thermus thermophilus
PVEITVKELLEAGVHFGHERKRWNPKFARYIYAERNGIHIIDLQKTMEELERTFRFIEDLAMRGGTILFVGTKKQAQDIVRMEAERAGMPYVNQRWLGGMLTNFKTISQRVHRLEELEALFASPEIEERPKKEQVRLKHELERLQKYLSGFRLLKRLPDAIFVVDPTKEAIAVREARKLFIPVIALADTDSDPDLVDYIIPGNDDAIRSIQLILSRAVDLIIQARGGVVEPSPSYALVQEAEATETPEGESEVEA

SEQ ID NO: 28638 - protein, 998 aa, Oryza sativa
MRLHYHHLAVVLLAAVAAAATAAAGGEADALLAVKAALDDPTGALASWTTNTTSSPCAWSGVACNARGAVVGLDVSGRNLTGGLPGAALSGLQHLARLDLAANALSGPIPAALSRLAPFLTHLNLSNNGLNGTFPPQLSRLRALRVLDLYNNNLTGALPLEVVSMAQLRHLHLGGNFFSGGIPPEYGRWGRLQYLAVSGNELSGKIPPELGNLTSLRELYIGYFNSYSGGIPPELGNMTDLVRLDAANCGLSGEIPPELGNLANLDTLFLQVNGLAGGIPRELGKLASLSSLDLSNNALAGEIPATFADLKNLTLLNLFRNKLRGDIPEFVGDLPSLEVLQLWENNFTGGIPRRLGRNGRFQLLDLSSNRLTGTLPPDLCAGGKLETLIALGNSLFGAIPASLGKCTSLTRVRLGDNYLNGSIPEGLFELPNLTQVELQDNLISGGFPAVSGTGAPNLGQISLSNNQLTGALPAFIGSFSGVQKLLLDQNAFTGEIPPEIGRLQQLSKADLSGNSFDGGVPPEIGKCRLLTYLDLSRNNLSGEIPPAISGMRILNYLNLSRNQLDGEIPATIAAMQSLTAVDFSYNNLSGLVPATGQFSYFNATSFVGNPGLCGPYLGPCHPGLLALSIAFAAMAILKARSLKKASEARAWKLTAFQRLEFTCDDVLDSLKEENIIGKGGAGTVYKGTMPDGEHVAVKRLPAMSRGSSHDHGFSAEIQTLGRIRHRYIVRLLGFCSNNETNLLVYEYMPNGSLGELLHGKKGGHLHWDTRYKVAVEAAKGLCYLHHDCSPPILHRDVKSNNILIDSDFEAHVADFGLAKFLQDSGTSECMSAIAGSYGYIAPEYAYTLKVDEKSDVYSFGVVLLELITGKKPVGEFGDGVDIVQWVKTMTDSNKEHVIKILDPRLSTVPVHEVMHVFYVALLCVEEQSVQRPTMREVVQILSELPKPTSKQGEEPPSGEGAVFDLVVPAESAEANEAKEQQQQQLNSPSSPPPDLISI

SEQ ID NO: 28639 - protein, 315 aa, Glycine max
GSLVKISSRIPKKKRCKLEPGEGESCKRCNCKKSKCLKLYCECFAAGVYCIEPCACHDCFNKPIHVETVLQTRQQIESRNPLAFAPKVIRNSDSVPEIGDDPNKTPASARHKRGCNCKKSSCLKKYCECYQGGVGCSISCRCEGCKNAFGRKDGSAPVGIETDPEETEASDKGMVEKTLQKTEIQNTENHPDSATVSTPLRLSRPLLPLPFSSKGKPPRSFVTTISGSALFANQKLGKPNPLWSQAKHFQTVPDEEMPDILQGDSSPITCIKTSSPNGKRISSPNCDLGLSPSRRGGRKLILQSIPSFPSLTPHP

SEQ ID NO: 28640 - protein, 555 aa, Candida glabrata
MASSNTYSNFKLATELPAWSKLQKLYDAQGKSLNVKEEFQKDSARYNKYAKTLTNYDGSKILFDFSKNLINDEILATLIELAKEAKVTDLRDAMFAGEHINFTEDRAVYHVALRNRANKPMKVDGVDVAPEVDAVLQHMKEFSEQVRSGEWKGYTGKKITDVVNIGIGGSDLGPVMVTEALKHYAGVLDVHFVSNIDGTHIAEVLKVVDPETTLFLVASKTFTTAETITNANTAKNWFLSKTGNDQSNIAKHFAALSTNETEVAKFGIDTKNMFGFENWVGGRYSVWSAIGLSVALYIGFDNFEAFLKGAEAVDKHFVETPLEDNIPLLGGLLSVWYNNFFGAQTHLVAPFDQYLHRFPAYLQQLSMESNGKSVTRGNVFSTYSTGSILFGEPATNAQHSFFQLVHQGTKLIPSDFILAAQSHNPIENNLHQKMLASNFFAQAEALMVGKDEAQVKSEGATGGLVPHKIFSGNRPTTSILAQKITPAALGSLIAYYEHVTFTEGAIWNINSFDQWGVELGKVLAKVIGKELDNTEKITAHDASTNGLINQFKEWL

SEQ ID NO: 28641 - protein, 199 aa, Trifolium subterraneum
GLAFMAAAKGYKLIITMPASMSLERRIILLAFGAELVLTDPAKGMKGAVQKAEEILAKTPNAYILQQFENPANPKVHYETTGPEIWKGTDGKVDAFVSGIGTGGTITGAGKYLKEQNSNIKLIGVEPVESPVLSGGKPGPHKIQGIGAGFVPGVLEVNLIDEVVQISSDEAIETAKLLALKEGLFVGISSGAAAAAIQI

SEQ ID NO: 28642 - protein, 442 aa, Bradyrhizobium japonicum
MLDETAGRAPGGAARWWLAQSLRALGAEIAARGGSLILRKGPAAGVIPEEARESGARAVYWNGIAQAPHQAIERRLEAALAKLGVDSQSFPGDLLVPPSAIRNKEGRGLRVFTPFWRRVLSLGDPPKPLPAPKQLRPGPKIVSDRLESWQLAPTKPDWAGGLRERWTPGEASARARLRDFLKTIARGYAGDRDRPDRVGTSGLSPHLRFGELSPRQVWHAARFAAAEDAALGPGIEKFLSELGWREFCRHLLHDHPDLATENLQTNFDGFPWQSDGKVLAAWQRGRTGYPIVDAGLRELWHTGVMHNRVRMVVASFLVKHLLIDWRDGEAWFWDTLVDADAGSNPANWQWVAGCGADAAPYFRVFNPQLQGEKFDPDGTYVRRWVPELQGLPAKLIHQPWQATPNELASAGVTLGKTYPQPIVDHARGRERALSAYAKIRKG

SEQ ID NO: 28643 - protein, 281 aa, Sulfolobus tokodaii
MKHMVKIAMIQMGSVESKEANIQKALEYTKAAVKDGAELIVYNELFTTQYFPATEDPKFFDLAEPEDGPTVRVFAEFSKQYKIGMIITIFEEDKKIKGIYYDTAIFIKDGKVLGKYRKTHIPQVPGYYEKFYFKPGKEYPVFDFGGYKIGAVICYDRHFPEGVRILTLKGADIVTIPTTTNFYPETWELELRAHAAFNTIYVVGVNRTPEIFQGKEIDYFGKSLVADPTGNILKEMSSQEGYEIVDVNLDFIRERRKKAPFLRDRKPENYTEISSLYIETI

SEQ ID NO: 28644 - protein, 555 aa, Desulfitobacterium hafniense
MKELYDLIIIGSGSAGMAAGIYAGRSKLKTLVIDRDRAGGQIKITSEVENYPGILNISGEELSQAMRRQAEKFGVKFRQAAVESVDLAGDIKKIRTAEGDYEALAVIIATGSVPRKLGFIGEEEFRGRGIGYCATCDGEFFTGMDVFVIGGGLAAAEEGIFLTRYARKVTMIVRGDGFSCPQTISERVLAHPKIEVKFNTELREAGGDAVLRYAEFVNNRSGERWRYDVREQKQTFGVFVFVGYIPQSAEYAQEVRIDERGYIPTDESMGTNVEGVYAAGDIRPKELRQLVTAVADGAIAATSAEKYLVGKKERLGLGELGELGESGERDELSDEEKTPVTRQGTSLLDDSLKEQLVPILERLENRIGLLAFLEGSSGFSEELRSFLSEFAGLTDKVEVEFLNRGEDAVREKEAKITLFPAVAVLGPDGVYTGVQFHGIPGGHEINSFILALYNAAGPGQAVGEETLAKIRRVSRKVNFKIGVSLSCTLCPDVVTLAQLMALKNPLIEAEMIDVAHYPDFKNKYGIMSVPAIVVNDEKVVFGKKNLEELLELAGG

SEQ ID NO: 28645 - protein, 614 aa, Glycine max
MMMFEDMGFCGDLDMLCVSLGEGDIAVRQTEPDPVVEDDYSDEEIDVDELEKRMWRDKMRHKRLKEQTKSKEGTDATKQRQSQEQARRKKMSRAQDGILKYMLKMMEVCKAQGFVYGIIPEKGKPVTGASDNLREWWKDKVRFDRNGPAAIVKYQADNAIPGKNDGCNSIGPTPHTLQELQDTTLGSLLSALMQHCDPPQRRFPLEKGVPPPWWPTGNEEWWPQIGLPKDQSPPPYKKPHDLKKAWKVGVLTAVIKHMSPDIAKIRKLVRQSKCLQDKMTAKESATWLAIINQEEALARELYPDYCPPFSSAGGNGSLVINDCSEYDVDGAEEELNFDVEDRKPDHLLPSNLGMERMRGRMPIQQPSHPMKGDVVTNLDFIRKRKISSDFNMMMDQKIYTCEHPQCPYSEVRLGFHDRSARDNHQLNCAYRNSSADYGGGPNFHATEDKPVIFPQSFVQPNTTTQSASLVAPSFDLTGLGVPEDGQKMISDLMTIYDTNVVGNKNLSSSNCVAVENHNLSQASLQQQESYFPGQGMVLEGNFFAREEGQFDRFKATMNMNTHTPFDTNHSNNNNIHLMFNSPCDLSSFDFKEDIQGGVGMDPLHKQQEVSIWYQ

SEQ ID NO: 28646 - protein, 491 aa, Mycobacterium smegmatis
MHRSPPRLAPSDVTEGTFSPYSPYNTSLYEEYDYTIDDVEGALPDGLRGTLYRNGPGKLDAGGQQLGHLFDGDGMLSMFVMSDGTVRFRNRYVRTKHYEKSLASKGAPYRALGTMRPGGILANALRLPANVANTGVVMHAGKLLALWEGGRPTRIHPDTLDTLGAHDFDGGLKWLGAFSAHPKWDFATGDMFNFGLAMFPTPKLICYRVDRTGRLHRLGHVPLPRPMFNHDVGLTHHHMVFVIPPLVFPLRRSLEAGIGVRNFIDAIDFDATRGTMIALVPRDGGRSRILHTDPSLHLHLSNAYEDGEDTVVELVDYHSSWQELNGQLSLVPTLAQTATMPYGGQLTRLRITPSGHVSREPITDLYGEFPMLNVKTMASQNRYTYLSAALGGNIYPNAVAKIDNTTGKETVYRLPDGHLPHEAIFAAHPDGVDEDDGWLLVPVIDGVENIASLIILDAKDIEAGPVYQGRLRHHLPLTFHGCYTPRVAAPA

SEQ ID NO: 28647 - protein, 290 aa, Glycine max
LANLEMMEPCSSVKDRIGYSMIVDAEEKGFITPGESVLIEPTSGNTGIGLAFMAAAKGYKLIITMPSSMSLERRTILRAFGAELVLTDPAKGMKGAVHKAEEIRDKTPNSYILQQFENPGSPKIHYETTGPEIWKGSSGKVDALVSGIGTGGTITGAGKYLKDQNPDIKLYGIEPVESPILSGGKPGPHKIQGIGAGFIPGVLDVDLLDEVVQISSEEAIETAKLLALKEGLLVGISSGAAAAAAIKIAKRPENAGKLIIAVFPSFGERYLSSVLFESVKREAESMVFEP

SEQ ID NO: 28648 - protein, 527 aa, Clostridium difficile
MINLEEKYLTRKDTYMIKILEYNGHIRNWKVLCEELGIDSSLCRDERERAILVEAYKTWGYDMANHMHGMFAFALWDTVEKKLFCLRDQFGVKPFYYYETENGKLLYGSSIRKIMEQPGFVKELNEDMLQIYMSFTYVAGENTFFRGVKKLMPGHYLVYQNKTVCIGRYWKPEFHPDNSKSIEEWTDEIHTTLQKIMPEVKSENETAELFLSGGVDSSYILAMSDIEKTGSCGYEEERFDESKLAQQTANILGCKNSRYIITPEEYFASVPYVMYHMEQPTGDASAIVFAIGCKAAAENTNICYSGEGADEFFGGYNIYHKAECYGENLKTFYIGNTNIMNEGEKRKILKKYNPDVLPIEVVKGIYEETEELDTLTNMSNVDIQIWLEGDIYFNIDKMSTAVGLEVRMPLTDTRIFDIASRIPSEYKVKGKENKIAFRTAASKTLPEEIAFRNKLGFIVPIRIWMADDQYNKDIRDKFNSEIADKFFNIDEINEIFNDYISGNSDNWRKIWMIYTFLVWYEIYFVKC

SEQ ID NO: 28649 - protein, 346 aa, Unknown
  Fragaria x ananassa
MYFSYTTLKNTFMAPILLLLVLFMPALQITGGQSAGVCYGRNGDNLPSDTEVIDLYKSNGIGRMRIYEPNQATLEALRGSNIELMVTILNNNLQALTDAAAATDWVQKNVQPYSADVKFKYIAVGNEVHPDAAEAQYLLPAIQNIQNAVKAANLQGQIKVSTAIDTTLLDPSFPPSDGAFSSAANSFITPIITFLGNNGAPLLVNIYPYFAYIGDPANIKLEYALFTSPGVVVQDGSNGYQNIFDAILDTHYSALEKAGAPNMVIVVSESGWPSEGSDAATNGNAGTYYSNLINHVKTGTPKRPNGAIETYLFAMFDENLKDGAEVEKHFGIFSPNKQPKYQLTFG

SEQ ID NO: 28650 - protein, 419 aa, Methanosarcina barkeri
MKEVTVGSRSKLLEGVKQHLCTCAAGLKLTPDMEAFLEMPMRELYVSLPVHMDDGSIKVFKGFRVQYNEALGPTKGGVRFHPEDTMETTRALAALMTWKCALHKLPLGGAKGGVICNPKELSHREIERLSRAYIRGIYQIIGPDRDIPAPDIYTNPQVMAWMMDEYSKLAGRNVFGSITGKPTSLGGSAGRYDATARGGLYTIREAAERIGISLKASRVAVHGFGNVGYHAAYLANKLYGCKVVAVSDSKGAIFSPYGLDPEDVSGHKHSTGSVLDYPEAENLTNKELLELDVEILIPASLENIITEENAGNIKARILAEMANGPTTVEGEAILNSKGIHIIPDILCNGGGVIVSYFEMVQNQSSTQWEEEEVQNRLERKMKEAYFSVYDFASKNNVEMRQAAYTLAVGRVVEAMQLRG

SEQ ID NO: 28651 - protein, 730 aa, Solibacter usitatus
MAKVPGSQDERTSRYGPHLNYTPPGGWKGESGKGGENLVKTHCCFCGQQCGIQLKVRDNRVMGFEPWEEFPFNRGMLCPKGVKRYMQGSHPDRLLDPLMRTPEGFRPAKWDEALDFTARRLRELQEKYGKDSVAVYGGASLTTEKSYLMGKFARVGLGTRHIDYNGRLCMVSAGTAYKTALGVDRAPNPWNDISEAEVLFVIGANIGECAPITTDYIWRARDKGAKLIVADPRFTPIARNADLYLPVRPGTDLALLMGMLHVIIRDGLTDPAFIEAHTTGFEKTAESVEAWNPRRAAEVSGVAPEAIEKAAHLIGESRRAMLMHARGLEHQSKGVENCEAVVAIALATGNIGREGAGPIMVTGQGNGQGGREHGQKCDQLPGQRSLTDPAARAHVAGVWGISPDDLPQPGYTAVEIMNAIHSGEIKGLLSICFNPLVSLPDANFTREALEKLEFFAVIDFFLSETAAHADVVLAGSLQEEEEGVTANVEARVIHIKKAVDPPGNARADSSIICDLAHRLGRGQFFPFKEPREIFEELRRASQGGLADYYGITYEKIDQQMGVFWPCPTLDHPGTPRLFEDGRFFHPDGKARFMSLVWRDSGDPVDAEFSIYLTTGRVVSQYLSGTQTRRIGALVDQYPEPKLELHPRLAEQHKINSGDWVTVTSRRTAITLQAMVVRTIRPDTVFIPYHWPGGRSANRLTHRTLDPRSKIPEYKVSACRIEKAVAPGGQS

SEQ ID NO: 28652 - protein, 451 aa, Exiguobacterium sibiricum
MNIICWIRSDFRLEDNHMLARAVEYLEKDEQANVEFVFWVNPDYIGEYDARQQYFFQALEHFAKNCKTHDMPIRFIEGQEKDFLEATEMADVLLFNAEYVEPFKSRDDGIMKKRGDKKTERLLDRHLLHPHAVKKNDGSYYKVFTPYKNAFLKKDVDKPYPVKLNLLKERYHKRRQNNAFMLDYFKRAASDTDFAVGEETARKRLRSFLKNNLSAYEEQRDLPAVDGTSLMSRYLRTGEIGIRTIFDAVQQEQDSKGKQTYLTELIWREFYYTILMHYPESKRLPVNEQYTKIEWETDEKGFKAWAEGKTGYPIVDAAMRQLNTTGWMHNRLRMIVASFLTKDLLVDWQKGERYFQQKLVDYEAASNIGGWQWAASVGTDAVPYFRVFNPTTQSKKFDKDGTFIRTYLPELKDLPKTSIHEPTEQQRKDYDYPMPIVEHDMARKRAIARFK

SEQ ID NO: 28653 - protein, 308 aa, Corynebacterium glutamicum
MYNNITETIGHTPLVKLNKLTEGLDATVLVKLESFNPANSVKDRIGLAIVEDAEKSGALKPGGTIVEATSGNTGIALAMVGAARGYNVVLTMPETMSNERRVLLRAYGAEIVLTPGAAGMQGAKDKADEIVAERENAVLARQFENEANPRVHRDTTAKEILEDTDGNVDIFVASFGTGGTVTGVGQVLKENNADVQVYTVEPEASPLLTAGKAGPHKIQGIGANFIPEVLDRKVLDDVLTVSNEDAIAFSRKLATEEGILGGISTGANIKAALDLAAKPENAGKTIVTVVTDFGERYVSTVLYEDIRD

SEQ ID NO: 28654 - protein, 466 aa, Corynebacterium efficiens
MKFHCKFTCPRCRDGNVEFMTVDEQVSNYYDMLLKRNAGEPEFHQAVAEVLESLKIVLEKDPHYADYGLIQRLCEPERQLIFRVPWVDDNGQVHVNRGFRVQFNSALGPYKGGLRFHPSVNLGIVKFLGFEQIFKNSLTGLPIGGGKGGSDFDPKGKSELEIMRFCQSFMTELHRHIGEYRDVPAGDIGVGGREIGYLFGHYRRLANQHESGVLTGKGLTWGGSLVRTEATGFGTVYFVQEMIKAEGETLEGKKVIVSGSGNVATYAIQKVQELGAVVVGFSDSSGWVSTPNGVDVAKLREIKEVRRARVSSYADEVEGAEYHTDGSIWDLTADIALPCATQNELDGDNARTLADNGCRFVAEGANMPSTPEAIDVFRERGVLFGPGKAANAGGVATSALEMQQNASRDSWSFEYTDERLHRIMKNIFKSCADTAKEYGHEKNYVVGANIAGFKKVADAMLAQGVI

SEQ ID NO: 28655 - protein, 317 aa, Unknown
  Shewanella sp. MR-4
MSQVRHSNLLILGSGPAGYTAAVYAARANLKPVMITGMQQGGQLTTTTEVENWPGDAEDLTGPALMERMQKHAEKFDTEILFDHINEVTLTERPFRLKGDNGEYTCDALIIATGASARYLGLESEEAFKGRGVSACATCDGFFYRNQKVAVIGGGNTAVEEALYLSNIAAEVHLIHRRDTFRSEKILIDRLMDKVANGNIILHLDQTMEEVVGDAMGVTGLKMKSTKDGSITDLAVAGVFVAIGHSPNTGIFEGQLEMNNGYLKVQSGLQGNATQTSIEGVFAAGDVMDQHYRQAITSAGTGCMAALDAERYLDAKK

SEQ ID NO: 28656 - protein, 289 aa, Geobacter sulfurreducens
MSDRCTLIVNPVSGSYSEAAVSAAMDALRRGGLAPRLLLTGGPDDAAAFAARLCAQEEHPFVIAVGGDGTVNGVLNGLEPGRATLGYIPFGTANVLGRELGLRSAEDAVARIVRRETRSLATGLLEGFGVRRRFFLMAGIGFDGQVVEGVRSDEKKRFGAGAYLFSAIRTLAAWDRRLLEVEVDGVAIACHGAVICNAARYGGPFTLAPGANLFHDGFRVVLIRDPSRWRYLSLALRVAAGRRAGGGPEVVSARRVAVGGNKPVQVDGDFICHSPVTVTAEADFARLVV

SEQ ID NO: 28657 - protein, 583 aa, Kluyveromyces lactis
MTITKLLRDPQTEPKWWKEAIVYRFQDSNHDGWVRYQRYVSKLSTLKELGANAIWICPFYDSPQEDMGYDISDYEKVWPRYGTNEDIFNLIDRAHGLGIKSIVDLVINHCSSEHAWFKEARSSLDNPKRDWFIWKAPKGFDSNGKPIPPNTWRSFFGGSAWRYDEHTGQFYLRLFAKGQPDFNWENEVTRNAIYESAVGFWLDHGVDGFRIDTAGLYSKQPGFPDVPIINPGLDFQHPDPAILNGPRIHEFHKEMNKFMRERVKDGRELLTVGEIPCGTHDVCKAYTSAKDQEITQLFEFEHVSVGRKPGNVGVVNFKLSEFKDGIAARFQFIDKTDSWSTVYIENHDQPRSVTRFGDDSPEYREISAKLLALLETSLTGTLYVYQGQELGMINFRDWPIEKYEDVEVKGMYKWMVDQFGADSDQVKDYVNGLQLISRDHARTPFPWTSEAPYAGFTDGKEPWFPLTETFQEGINAEDELKDPKSVFNFWKTAIEVRKTHKDVLNYGYDFTFVDHANKKLFAFTKKFGEKVLYVVLNFSKEEIEFSFLEGYNSYDYIFGNYPEAEIDLDLTSLQPWEGRFYYA

SEQ ID NO: 28658 - protein, 270 aa, Triticum aestivum
MAAADDIGASAGRWSLHGRRALVTGGTRGIGRAVVEELAALGAAVHTCSRKEAELGERLKEWEAKGFRVTGSVCDVSVRDQRELLLQDVAGRFAGKLDILINNVGTNHRKPTTEYSADEYSFIMATNLESAYHLCQLAHPLLKASGVASIVFISSVSGVVAISSGSIYGMTKGAMNQLAKNLACEWAKDNIRINSVAPWYIKTSLVEEDLAKEDFVDSIARRTPMRRVGEPEEVSSLVAFLCMPGSSYITGQTISVDGGMTINGMYPTEN

SEQ ID NO: 28659 - protein, 755 aa, Cryptococcus neoformans
MAAGLAYDLVLIFWRIVINIFFREIRPRGAFNIPREGPVLFICGPHANQFLDPLLLFSEARKEAGRRVSVLTAAKSMNRKFIGAVARIMDSIPVARAADYAAAGKGRIILSESDPLIVTGIGTSFIEQVKPRSQLMLPKSAGYASAPVAEVISDTEIRLKSEFVVPSKDGSANVKASHRVRNESELKEGLQFKVLPHVEQEDTYGACFQRLYEGGCIGVFPEGGSHDRTDFLPLKAGFSIMALGAIAAHPGLDVKLVPVGLSYFHAHKFRSRAVIEFGSPISVDPELVELYKQGGAKKREACGKLLEQVHDGLRAVTLRAPDWETMQVIQAARRLYRVPGQHLTLGQVVELSKRMMEGYLTYKDEPKIIDLRQKVIAYNRLLRDMGIADHQVERASSRSIKSLLLLVYRVGLLLWWSILALPGALLHAPVFILAKLISIQKAKEALAASTVKIQGRDVLATWKVLVSLAVTPLLYIFYSVLATFLAYKYDLAPEWRHWTPVVIFCWLPGWAMASLKFGEAGVDVAKSLRPLFLSVWPYNQREVNRLREMREGLTNEISEVIDEFGPQLYDNFQKGRILPSASVPQTGRNPGLLSRKSQTADSSVLSHPMLWLDERIFGWSRSASVGQSVWSSSAANKQQESEAAPASPYDSEGEEEEEADVDYDDVLAIIDTRRSSGGGVGLASPKGKKRRYTGQARSEGSVASPKSDIEGVPLPRADDNGVVKLHKRPGAAKDGISETKGEEGLGLDTGREKGQ

SEQ ID NO: 28660 - protein, 112 aa, Unknown
  Oceanobacter sp. RED65
MKLVTAVIKPFKLDDVREALSEIGVQGITVTEVKGFGRQKGHTELYRGAEYVVDFLPKVKLEIAIDDSLTEKVIEAVSKAANTGKIGDGKIFVTSLEQIVRIRTGETGADAV

SEQ ID NO: 28661 - protein, 292 aa, Haloarcula marismortui
MTDETDETDPQTAIDSVAGNRDDRVYEYSAGDDQEGIPFVGAGPGNPRLLTVAGRELLADADLVVHAGSLVNSELLEEYCEDAETVSSIGKDLEELIPLMRDAYEAGDTVVRLHSGDPAIYGAALEQMDALEHEGVPTYIVPGVTSAFAASATMRTQLTLNEVANHVAFTRPQGKTLDEDEDHISEFVGMGDVTTCIYLGTHAVSETMDRLLEDGHDPETPVAAIYHASWPDEDVIEGTIATIGEKLEDAGYRASAMVVIGDAVGGEDYERSFLYGDWANRGSDADSQEADD

SEQ ID NO: 28662 - protein, 566 aa, Xylella fastidiosa
MLAAAMRGMAVTFFSQFMVSCMHSIQIVLAMLLVVAASGYLVRIIPFSMPLPLLQIALGAVISGVFDGGYELQPEVFFLLFLPPLLFLDGWRIPKQGLFRDKNVILELALGLVVFTVLGIGFLIHWMIPTMPLPLAFALAAILSPTDPVALSSITSRVPIPKRMMHILEGESLLNDATGLVCFQFAVAAVLTGNFSLATASLTFVWVLVVGLSLGIATTYVLSRVQRWVWRHFGGEPAAAILVNLLTPFAAYLLAESMQASGILAAVAAGITMSYVELSGNAQATIRVQRWAVWETVQFTFNGIIFVLLGEQLPGILDDLVHSAQQAGHMNVGWLLVDVAVISAGLMLLRFLWVWLSLQWNLFKAVCCGKQRISPPWQIVVAMSLSGVRGAVTLAGVLTLPFLMPDGTPLPARQLVIFLAASVILVSLLLASVALPYLLRGLELPEKSSYDKEEDFARKVSAQAALEAVERLRQRLVEDSANAERYNEAAHQVSQLYQRKLGAVDLANVDPQETKVFEQVVRRFRQVGLAAERDELFRLAREHNISDELLQRMVRNLDLIEARRRS

SEQ ID NO: 28663 - protein, 419 aa, Unknown
  Candidatus Kuenenia stuttgartiensis
MPEKMEENSPWQTALTQFNNVSKRMNLPEDIHQILKHFSRILTVSVPVRMDNGSTASFEGFRVQHCSAKGPYKGGIRYHPDLTLDDLKALAMEMTWKCSLVDIPFGGAKGGVVCDPKKLSRGELERITRRYTYAIQPIIGPDIDIPAPDVNTNEQIMAWIMDTYSMNKGFCSPGIVTGKPLNIGGSLGRADATGLGVAYIAASAVRQNKKTLKGLNVVIQGYGNVGSAAGKFLEEMGCKIVAVSSSTGGIYNPGGLSHNAIIEHYRKTGGFRYFPLAENITNAELLELPCDVLIPAAMGGQITKKNAGKIKAKLIVEGANGPTTPEADEILSGRKIKIVPDILANAGGVIVSYFEWVQDAQCYFWCKNEVNAKLKILLERSFNDVYAFAQKNKYSLRTSAMMLAIKKVADVFTVRGLYP

SEQ ID NO: 28664 - protein, 465 aa, Zea mays
MALLLLLLAVLGVVLASSLLLRWNELRYSRRRGLPPGTMGWPLFGETTEFLKQGPSFMKQRRLRYGSLFRTHILGCPTVVCMEPELNRRALASEGAGFVPGYPQSMLDILGPNNIAAVHGPLHRAMRGAMLALTRPHMIRAALLPKIDAFMRAHLHGWAGRRVDIQEMTKEMALLSALRQIAGISAGPHSDALKAELYTLVLGTFSLPINVPGTNYSKGLQARKKLVAMLRQMIADRRSSGCARDDMLDALLSGNEGTRAKLSDDQIIDLLITLIYSGYETVSTTSMMAVKYLSDNPKALGQIRKEHLDIRKAKSPEDPLDWNDYKSMTFTKAVIYETLRLATVVNGLLRKTTHDVEMNGYVIPKGWRIYVYTREINYDPFLYPEPMVFNPWRWMETNLESHPHFMLFGGGARMCPGKEVGTVEIATFLHYFVTRYRWEEEGNNTISKFPRVAAPNGLHIRVQDY

SEQ ID NO: 28665 - protein, 487 aa, Escherichia coli
MTRRGKCRGALPSDTLSRGFRMGQSSQPHELGGGLKSRHVTMLSIAGVIGASLFVGSSVAIAEAGPAVLLAYLFAGLLVVMIMRMLAEMAVATPDTGSFSTYADKAIGRWAGYTIGWLYWWFWVLVIPLEANIAAMILHSWVPGIPIWLFSLVITLALTGSNLLSVKNYGEFEFWLALCKVIAILAFIFLGAVAISGFYPYADVSGISRLWDSGGFMPNGFGAVLSAMLITMFSFMGAEIVTIAAAESDTPEKHIVRATNSVIWRISIFYLCSIFVVVALIPWNMPGLKAVGSYRSVLELLNIPHAKLIMDCVILLSVTSCLNSALYTASRMLYSLSRRGDAPAVMGKINRSKTPYVAVLLSTGAAFLTVVVNYYAPAKVFKFLIDSSGAIALLVYLVIAVSQLRIRKILRAEGSEIRLRMWLYPWLTWLVIGFITFVLVVMLFRPAQQLEVISTGLLAIGIICTVPIMARWKKLIMWQKTPIHNTR

SEQ ID NO: 28666 - protein, 368 aa, Pseudomonas syringae
MTGAQRWVVKIGSALLTADGKGLDRNAMGVWVEQMAALHEAGVELVLVSSGAVAAGMSRLGWTARPSAMHELQAAAAIGQMGLVQAWESSFAEHGRHTAQILLTHDDLSDRKRYLNARSTLRTLVELGVVPVINENDTVVTDEIRFGDNDTLAALVANLVEADLLVILTDRDGMFDADPRNNPEAQLIYEARADDPALDAVAGGTGGALGRGGMQTKLRAARLAARSGAHTVIVGGRIERVLARLKGGERLGTLLSPERGMLAARKQWLAGHLQTRGTLVLDDGAVAALAKDQKSLLPVGVKLVQGSFRRGEMVVCVASDGREIARGLSNYSAIEAQKIIGHSSESIVRELGYMAEPELIHRDNLILV

SEQ ID NO: 28667 - protein, 414 aa, Campylobacter jejuni
MSLEMFDKEIFDLTNKELERQCEGLEMIASENFTLPEVMEVMGSILTNKYAEGYPGKRYYGGCEFVDEIETLAIERCKKLFNCKFANVQPNSGSQANQGVYAALINPGDKILGMDLSHGGHLTHGAKVSSSGKMYESCFYGVELDGRIDYEKVREIAKKEKPKLIVCGASAYARVIDFAKFREIADEVGAYLFADIAHIAGLVVAGEHPSPFPHAHVVSSTTHKTLRGPRGGIIMTNDEELAKKINSAIFPGIQGGPLMHVIAAKAVGFKFNLSDEWKVYAKQVRTNAQVLANVLMDRKFKLVSDGTDNHLVLMSFLDREFSGKDADLALGNAGITANKNTVPGEIRSPFITSGLRLGTPALTARGFKEKEMEIVSNYIADILDDVNNEKLQKNIKQELKKLASNFIIYERAMF

SEQ ID NO: 28668 - protein, 200 aa, Vicia sativa
GLAFMAAAKGYKLIITMPASMSLERRIILLAFGAELVLTDPAKGMKGAVQKAEEILAKTPNAYILQQFENPANPEVHYETTGPEIWKGTDGKVDAFVSGVGTGGTITGAGKYLKEQNSNLKLIGVEPVESPVLSGGKPGPHKIQGIGAGFVPGVLDVGLIDEVIQISSDEAIETAKLLALKEGLFVGISSGAAAAAAIQI

SEQ ID NO: 28669 - protein, 485 aa, Fusobacterium nucleatum
MKKGKAYIIGAGPGDFELLTIKAKRIIENADCIIYDRLISDDVLKLAKKDAELIYLGKGNTEGGLIQDEINQTLVNKCLDGKNVARVKGGDPFVFGRGGEEIEALFKNEIEFEVIPGITSSISVPAYAGIPVTHRGLARSFHIFTGHTMENGKWHNFENIAKLEGTLIFLMGVKNLDLIVNDLIKYGKDSKTPVAIIEKGATKNQRVTVGNLENILGLVEKNKITPPAITIIGEVVNLRETFKWFETENLAKKILVTRDKKQAVEMSENISKRGGIPVELPFIEIENLKIDLKDLEKYKAILFNSPNGVKAFFENIKDIRCLANIKIGAVGVKTKEILEKYKIVPDFVPNEYLVDKLAEEVVKYTNENDNILIVTSDISPCDTDKYNSLYKRNYEKVVAYNTKKLKVDREKVLETLKDIDIITFLSSSTVEAFYENLDGDFFILGDKKIASIGPMTSETIKKLGMKVDYEAEKYTADGLLDVIFK

SEQ ID NO: 28670 - protein, 204 aa, Oryza sativa
MLSTSTVFLFGPKQITLAETTGGTFREYIDTFDGYSFLYPKSWIQVRGAGADIFFRDPFFLDENMSVEISSPSSSKYMTVEDLGPPEKAAERVLQQYLTEFMSTRLGVRRTSNILSASSKVADDGKLYYEVEVNIKSFASNNELAVMPQDRVQRLEWDRRYLSVLGVENKRLYELRLQSPEKVFKEEEGDLRRVMDSFRVNKTA

SEQ ID NO: 28671 - protein, 341 aa, Arabidopsis thaliana
MAAKLISTGFRHTTLPENYVRPISDRPRLSEVSQLEDFPLIDLSSTDRSFLIQQIHQACARFGFFQVINHGVNKQIIDEMVSVAREFFSMSMEEKMKLYSDDPTKTTRLSTSFNVKKEEVNNWRDYLRLHCYPIHKYVNEWPSNPPSFKEIVSKYSREVREVGFKIEELISESLGLEKDYMKKVLGEQGQHMAVNYYPPCPEPELTYGLPAHTDPNALTILLQDTTVCGLQILIDGQWFAVNPHPDAFVINIGDQLQALSNGVYKSVWHRAVTNTENPRLSVASFLCPADCAVMSPAKPLWEAEDDETKPVYKDFTYAEYYKKFWSRNLDQEHCLENFLNN

SEQ ID NO: 28672 - protein, 442 aa, Arabidopsis thaliana
MAMAELSTPKTTSPFLNSSSRLRLSSKLHLSNHFRHLLLPPLHTTTPNSKISCSVSQNQAPVAVQENGLVKTKKECYGVFCLTYDLKAEEETRSWKKLINIAVSGAAGMISNHLLFKLASGEVFGPDQPIALKLLGSERSIQALEGVAMELEDSLFPLLREVDIGTDPNEVFQDVEWAILIGAKPRGPGMERADLLDINGQIFAEQGKALNKAASPNVKVLVVGNPCNTNALICLKNAPNIPAKNFHALTRLDENRAKCQLALKAGVFYDKVSNMTIWGNHSTTQVPDFLNARINGLPVKEVITDHKWLEEGFTESVQKRGGLLIQKWGRSSAASTAVSIVDAIKSLVTPTPEGDWFSTGVYTDGNPYGIEEGLVFSMPCRSKGDGDYELVKDVEIDDYLRQRIAKSEAELLAEKRCVAHLTGEGIAYCDLGPVDTMLPGEV

SEQ ID NO: 28673 - protein, 1307 aa, Magnaporthe grisea
MADAATLAAVAAIVENIATNSGAPGKNASFRSSTYVQLPGPESDEKKQLERELAALVIRVQQLETRANAAPATIFPDTPNETAYSLFGDDSSSPTSSSSGREPKRLKSASSTTRNGFTTDGRPSKLNAITDEELEGLREHVDGQSRLLDSQRAELDGVNAQLLEQKQLQERALAIIEQERVATLERELWKHQKANEAFQKALREIGSIVTAAARGDLSKRVKINPIEMDPEITTFKRTMNAMMDQLGVFSSEVSRVAREVGTEGILGGQAQIEGVDGTWKELTDNVNVMAQNLTDQVREIASVTTAVAHGDLTQKIESAAKGEILQLQQTINTMVDQLRTFASEVTRVARDVGTEGMLGGQADVEGVKGMWNELTVNVNAMANNLTTQVRDIINVTTAVAKGDLTQKVQAECRGEIFELKNTINSMVDQLQQFAREVTKIAREVGTEGRLGGQATVHDVQGTWRDLTENVNGMAMNLTTQVREIANVTSAVAAGDLSKKIRVEVKGEILDLKNTINTMVDRLGTFAFEVSKVARAVGTDGTLGGQAQVENVEGKWKDLTENVNTMASNLTSQVRGISTVTQAIANGDMSRKIDVEAKGEILILKETINNMVDRLSIFCNEVQRVAKDVGVDGIMGGQADVAGLKGRWKEITTDVNTMANNLTAQVRAFGDITNAATDGDFTKLVEVEASGEMDELKRKINQMVYNLRDSIQRNTQAREAAELANKTKSEFLANMSHEIRTPMNGIIGMTQLTLDTDLTQYQREMLNIVNNLAMSLLTIIDDILDLSKIEAKRMVIEEIPYTLRGTVFNALKTLAVKANDKFLDLTYRVDSSVPDHVIGDSFRLRQIILNLVGNAIKFTEHGEVSLTIQKGNDVTCLPNEYMIEFVVSDTGIGIPTDKLGLIFDTFQQADGSMTRKFGGTGLGLSISKRLVNLMGGDVWVKSQYGKGSSFYFTCRVRLADVDISLIRKQLKPYKGHQVLFIDKGKTGHGPEVGQMLGQLGLVPIVLESEQNHTLTRVRGKECPYDVIVVDSIDTARRLRGIDDFKYLPIVLLAPTVHVSLKSCLDLGITSYMTMPCKLIDLGNGMVPALENRATPSLSDNTKSFEILLAEDNTVNQRLAVKILEKYNHVVTVVSNGAEALEAVKDNKYDVILMDVQMPVMGGFEATAKIREYERSLGTQRTPIIALTAHAMMGDREKCIEAQMDEYLSKPLQQNHLIQTILKCATLGGALLEQNRERELELARHAEHKGGLSTDPARASSVMRPPLHHRPVTTAESLSGGAESPSLMANDGEDPIQRARSSLSEPGCL

SEQ ID NO: 28674 - protein, 375 aa, Xanthomonas oryzae
MTPILFVDRDGTLITEPADYQIDAYEKLRFVDHVIPAMLKLRDAGYQFVIVSNQDGLGSESFPRASFDGPNNLMLQIFASQGIEFREVLIDCSWPSDNAPTRKPGVGLMVPYLQDRTIDWARSAMVGDRITDIQFAQNLNIRGFQLRTDEFGGEWDWPGIAHELADAPRRAVVQRNTKETRIRVELDLDRVAEPKTATGLPFFDHMLEQIGKHGGFALDIRAEGDLHIDEHHTIEDTGLALGQALREALGDKRGIGRYGFDPESSPWQVAGDTAQHGFTLPMDETIASAALDFSGRPYFVFDGQFKRDRLGDMPTELVPHFFRSICDASGVNLHLTVRGENDHHKVEACFKALARALRQAIRREGSALPTTKGAL

SEQ ID NO: 28675 - protein, 117 aa, Zea mays
  misc_feature (17)..(17): Xaa can be any naturally occurring amino acid
  misc_feature (26)..(26): Xaa can be any naturally occurring amino acid
  misc_feature (45)..(45): Xaa can be any naturally occurring amino acid
MSALGKPQGTCARVDKXVLLSVRCKXSNANHVEEALRRAKFKFPXADRQKIIRNRKWGFTKFARAEYLKYKSEGRIAPDGVNATAFLAENIQASALTTFFCRFNYGVFGSILLKTKV

SEQ ID NO: 28676 - protein, 360 aa, Arabidopsis thaliana
  misc_feature (324)..(324): Xaa can be any naturally occurring amino acid
MEGDVGIGLVCQNTMDGKASNGNGLEKTVPSCCLKAMACVPEDDAKCHSTVVSGWFSEPHPRSGKKGGKAVYFNNPMWPGEAHSLKVEKVLFKDKSDFQEVLVFESATYGKVLVLDGIVQLTEKDECAYQEMIAHLPLCSISSPKNVLVVGGGDGGVLREISRHSSVEVIDICEIDKMVIDVSKKFFPELAVGFDDPRVQLHIGDAAEFLRKSPEGKYDAIIVDSSDPVGPALALVEKPFFETLARALKPGGVLCNMAESMWLHTHLIEDMISICRQTFKSVHYAWSSVPTYPSGVIGFVLCSTEGPAVDFKNPINPIEKLDGXAMTHKRELKFYNSDMHRAAFALPTFLRREVASLLAS

SEQ ID NO: 28677 - protein, 137 aa, Thermoanaerobacter tengcongensis
MPFEVGDIVEGTVLNITDFGAFIKLPEGKTGLVHISEVANTYVKNIRDFLKENDRVKVKILSMEPNGKISLSIKKAMPQKTPKEKDFAWQNSRNNNNSSFEEKLLKFLKDSDERQQQLRKHLDSKRRNTSYRRSNGY

SEQ ID NO: 28678 - protein, 430 aa, Unknown
  Synechococcus sp. RS9917
MSQRLSSAINAALVDADPAISGLIGKERERQETHLELIASENFASRAVMEAQGSVLTNKYAEGLPHKRYYGGCEHVDAIEELAITRAKELFGAAWANVQPHSGAQANFAVFLALLKPGDTIMGLDLSHGGHLTHGSPVNVSGKWFNVVQYGVDRDTQRLDMEAIRQLALQHRPKLIVCGYSAYPRTIDFQAFRAIADEVGAYLMADMAHIAGLVAAGVHPSPVPVCDVVTTTTHKTLRGPRGGLILCRDADFARQFDKAVFPGTQGGPLEHVIAAKAVAFGEALQPSFKTYAQQVVANAQALASRLQERGIAVVSGGTDNHVVLLDLRSIGMTGKVADLLVSDVHITANKNTVPFDPESPFVTSGLRLGTAALTTRGFDQGAFQIVADVIADRLLHPEDDAMQARCLERVRDLCQRFPLYDSSPVEPALA

SEQ ID NO: 28679 - protein, 236 aa, Brassica napus
  misc_feature (229)..(229): Xaa can be any naturally occurring amino acid
MERPMWMLLIVTALNWIAWFPFLLFDTDWMGREVYGGDSQGDARLKQIYNKGVQSGALGLMFNSIVLGFMSLGVEWIGKKVGGAKRLWGIVNFILAIGLAMTVLVTKLAADYRKVAGPYAGPSPGIRAGALSLFAVLGIPLAITFSIPFALASIFSSSSGAGQGLSLGVLNLAIVIPQMIVSLGGGPFDALFGGGNLPAFIVGAIAAAISGVLAITVLPSPPPDAPASXTGAMGFH

SEQ ID NO: 28680 - protein, 418 aa, Mycoplasma hyopneumoniae
MYKKIKLRDQQISELINLESKRQNSQIELIASENYASEDVILANGTSLSNKYGEGYPGKRYYGGCTFIDQIEKIAIERVKKLFKIEYANVQPYSGSSANAAVFAALLKPGDKILGLDLNAGGHLSHGYKINFSGMFYSGISYFLDENELLDYDAIEKIALKTKPNLIICGYSAYSRKIDFARFRQIADKVNAFLLADIAHIAGLIAAGQHPSPVGYAHIITSTTQKTLRGPRGGLILTNSKEIAAKIDKVVFPGIQGGPFFHTIAAKAVAFKEALEPWFKEYCAQIVKNASHFASEFIKKGIRIVSQGTENHLFTIDVLSSYNLNGKQAQILLESVNIITNKNTIPNDTLSPFVTSGLRLGTPAMTSRGFKEQEFSQMAEIIDFVLRKKELNALEIKEIKKKVKILTKNFPIKKSYWP

SEQ ID NO: 28681 - protein, 188 aa, Oryza sativa
LMEQSSAIKCPSISYHLVGTKKIQQELAKPNILERFLNNKEDIAKLRKCFAGLWSLDNEEIVKTAIEKPDLFVLKPQREGGGNNIYGYDLRETLVRLQKEQGEALAAYILMQRIFPRASLTHLVQGGVCFEDLTISELGIFGAYLRNKDKVVLNNQCGYLMRTKVSSSNEGGVAAGFAVLDSILLTDE

SEQ ID NO: 28682 - protein, 503 aa, Yersinia pestis
MFVPQPSNKPLSLMLAGLSVKKTAADSFMKCVVYSHQCVISATEGRMEQQLQNSSLKRGLKNRHIQLIALGGAIGTGLFLGIAQTINMAGPSVILGYAIGGFIAFLIMRQLGEMVVEEPVAGSFSHFAYKYWGDFAGFLSGWNYWAMFILVGMAELTAVGIYIQYWWPEIPTWVSAAVFFIIINAINLVNVRLYGETEFWFAIIKVAAIIGMIVFGAYLLASGSGGPAASVTNLWAQGGFMPHGFRGLIMAMAVIMFSFGGLEMVGITAAEAEDPRNSIPKATNQVVYRILIFYIGSLTVLLSLFPWNNVVEGGSPFVMIFDALDSPWVATALNVVVLTAALSVYNSGVYCNSRMLFGLASQGNAPKLLTKLNKRGVPIRSIALSALATSAGVVINYIMPGKAFELLMALVVSTLVINWVMICLAHLKFRKAKVKEGVVPRFKALWYPYGNYLCLVFLALILVIMYLTEGIRISVLMMPVWIALLWCGFVLTRRKCPKTVTSL

SEQ ID NO: 28683 - protein, 691 aa, Salmonella enterica
MTTNRAFEIRSGYSHTLGANYDGEGVNFAIFSAHAERVELCLYDPSGEHEIARLELPEYTDEIWHGYVPKLQPGALYGYRVYGPYDPENGHRFNPNKLLIDPYARELVSDIQWNDAHFAYQLLHDDKDLTFDDQDSAPFTPKCRVIDPAEANWEDRQRPSIPWSNAIIYETHVKGFTQLNSAIPEPLRGTFEGMGHKASVDYIKSLGITSVELLPVHWFPDDQHLLDKGLKNFWGYNSLGFFAPATRYYGPKGIQGFRDMVRAFHDAGVEVILDVVYNHTAEGNELGPTLSFKGIDNFSYYRTMPDQHRYYINDTGTGNTVNTSHPRVLQMVMDSLRYWAESMHVDGFRFDLGTILGREPEGFDQRGGFFDAVTQDPVLAKLKLIGEPWDIGPGGYQVGGFPPGWGEWNDKYRDTVREYWKGDNVTNDFAARLLGSGDLYDLRGRRSWSSVNFITAHDGFTLNDLVSYNDKHNEANGEDNNDGHNDNRSCNYGAEGPTDDEGINAIRERQKRNFLTTLLFSHGTPMLLAGDEFGRSQMGNNNGYCQDSEISWVHWDNLPETANALREFTRHLIQLRATQPLLRRESWRDGLEIRWFNAGGGAQQSEQWDEGSTIGVCISRPDLQPEAGIWHDALLLFNPFEGSVPFRIPMWGEGGWVLELTTADNAQQGMRITEEMDFDLAGRSIVLFRRP

SEQ ID NO: 28684 - protein, 480 aa, Desulfitobacterium hafniense
MRKSWKSFLLISLFLAVSSVLAFGCASQITPSPRTAATIPEGALDSETWGKVYPDQYASQNKQKEMTKGNSKYGGSLPESHLEKYPIEKRLFAGYGFSEDYNDERGHVYALEDVTTTLRVNEKTISSCWNCKSPQVPGLIEQMGDDFWSTPFLQLKDQITMPIACADCHDPETMNLRITRVTLLNALKERGIDPNQLSRQEMRTMVCAQCHVEYYFEPETKRVTYPWKYGLTANDAEKYYEEINFKDWNHAETGAPMLKAQHPDYELFSTGVHAANGVACADCHMPYVKEGTSKISSHHLQSPLNSISESCQTCHRQSEEYLKNQVIATQDKVFATRTVLENALADAMDAIKTADKNANAKADAMSKARDLHRKAQWRWDYIAAENSMGFHSPNEALRVLGEGIDFARQAQLQANLAVGTAAGGAANPDAGQTPGAGTANEAAGGATPLPDNKNNDKKPTDGDGSAPNDETKQTEEKKQS

SEQ ID NO: 28685 - protein, 139 aa, Herminiimonas arsenicoxydans
MRILHTMLRVGDLQRSIDFYTRVLGMKVLRTKENTEYKYTLAFLGYGSNPDHAELELTYNHGTDHYDMGTAYGHIAISVDDAYKACADVKAAGGNVTREAGPVKGGNSVIAFVTDPDGYKIEFIERKDEERPEESGRHV

SEQ ID NO: 28686 - protein, 626 aa, Saccharomyces cerevisiae
MNDDSQDKIIHDIRIQLRKAATELSRWKLYGSSKWAAEALAGLAEAIDVDQTHSLADESPLRNKQGVPKQMFEIPQNGFGLSETEYDLYLLGSTLFDAKEFDRCVFFLKDVTNPYLKFLKLYSKFLSWDKKSQESMENILTTGKFTDEMYRANKDGDGSGNEDINQSGHQRANLKMVSNEHESQSNISSILKEINTFLESYEIKIDDDEADLGLALLYYLRGVILKQEKNISKAMSSFLKSLSCYSFNWSCWLELMDCLQKVDDALLLNNYLYQNFQFKFSENLGSQRTIEFNIMIKFFKLKVFEELNGQLEDYFEDLEFLLQVFPNFTFLKAYNATISYNNLDYVTAESRFDDIVKQDPYRLNDLETYSNILYVMQKNSKLAYLAQFVSQIDRFRPETCCIIANYYSARQEHEKSIMYFRRALTLDKKTTNAWTLMGHEFVELSNSHAAIECYRRAVDICPRDFKAWFGLGQAYALLDMHLYSLYYFQKACTLKPWDRRIWQVLGECYSKTGNKVEAIKCYKRSIKASQTVDQNTSIYYRLAQLYEELEDLQECKKFMMKCVDVEELLEGIVTDETVKARLWLAIFEIKAGNYQLAYDYAMGVSSGTSQEIEEARMLARECRRHM

SEQ ID NO: 28687 - protein, 334 aa, Debaryomyces hansenii
MSNLQAAAEPTNDPFYGLSFKVGVAENKNVTYRAKMEDVHTYVANFAEKLDWGYFAIFDGHAGKQTARWCGNNLHTLLEHEIISNEDGNSNNLPNQGNEVDNSAPLSSKCFMQDYLNTTFIKADELIEKEKNGSAGCTAAVAVLRWETDDSKVLPESSQPPENNSGFDFMPSPNHRRMLYTSNVGDLRIVLYRKGKSYRLTYDHKATDSNEINRIRDSGGLIMKNRVNGVLAVTRSLGDSYMKDLVIGNPFTTATEITDEDEFMILACDGVWDVISDIKACQFVAETFKKDGDDQQLAAKKLCQLAMDNSTTDNVTVMIVKFDRKVFASQQNTV

SEQ ID NO: 28688 - protein, 463 aa, Unknown
  Nostoc sp. PCC 7120
MVNRRIAEILRSGQPDESLVVQGWVRTKRELKGFAFIEVNDGSSLGNLQVVINQDLPDYAVIVKQLNTGASVEVNGVLVASQGKGQRIELKAEAVKVYGEADPETYPLQKKRHSFEFLRTIGHLRSRTNSFGAVFRVRNACSAAIHQFFQERGFLWVHTPIITASDCEGAGELFSVTSLDLKQIPRTENQGIDYSQDFFAKPTYLTVSGQLEAEVMAMAFSNVYTFGPTFRAENSNTSRHLAEFWMVEPEMAFCDLEGDMDLAEAFLKHIFNHVLEKCPEDMEFFNQRIDNTVLATAENIINNQFERLTYTDAIKLLEKADVKFEYPVSWGLDLQSEHERYLAEQLFKKPVIVTDYPAQIKAFYMRLSDDEKTVRAMDVLAPKIGEIIGGSQREERLDVLERRVLAQGMQPEDLWWYLDLRRYGTVPHAGFGLGFERLVQFITGMGNIRDVIPFPRTPQNAEF

SEQ ID NO: 28689 - protein, 360 aa, Unknown
  Candidatus Kuenenia stuttgartiensis
MGVLTGGGDCPGLNAAIRAIVKSAVQKHNISVIGIEDGYDGLILPNKTRKLTPFNSRGILHVGGTILGTSNRANPFKYRITVNGKTEVRDVSSEVIQKTKLLELDALIVIGGDGSMNIASHLYDMGCPVVGVPKTIDNDVLFTDASFGFSTAVQIATEMLDRLHTTAESHHRVMVMEVMGRYAGWIAVASGIAGGADVILIPEIPYDREEVCQKILRRQKKGCRSSIVVVSEGAKEIGGALCILQSAEEGGSAERLGGAGEKAGLYIKKNTGIDVRVTTLGHVQRGGTPDAPDRILSTRFGAAAVNLIINNQFGRMVCLKGQDIESVPLSSVAGGQKKVPTETGLVITAEEIGVNFGRKA

SEQ ID NO: 28690 - protein, 192 aa, Zea mays
MSSAPLQIAPVPEHVCYVHCNFCNTILAVSVPSHSMLNIVTVRCGHCTSLLSVNLRGLIQSLPVQNHYYSQQQENFTVQNMGFTENYPEYAPSYRMPTTLSAKGDLDHMLHVRAPEKRQRVPSAYNRFIKEEIRRIKACNPDISHREAFSTAAKNWAHFPNIHFGLGPCESSNNLDEATGAMCHPQKVQDLY

SEQ ID NO: 28691 - protein, 468 aa, Escherichia coli
MSKQQIGVVGMAVMGRNLALNIESRGYTVSIFNRSREKTEEVIAENPGKKLVPYYTVKEFVESLETPRRILLMVKAGAGTDAAIDSLKPYLDKGDIIIDGGNTFFQDTIRRNRELSAEGFNFIGTGVSGGEEGALKGPSIMPGGQKEAYELVAPILTKIAAVAEDGEPCVTYIGADGAGHYVKMVHNGIEYGDMQLIAEAYSLLKGGLNLTNEELAQTFTEWNNGELSSYLIDITKDIFTKKDEDGNYLVDVILDEAANKGTGKWTSQSALDLGEPLSLITESVFARYISSLKDQRVAASKVLSGPQAQPAGDKAEFIEKVRRALYLGKIVSYAQGFSQLRAASEEYNWDLNYGEIAKIFRAGCIIRAQFLQKITDAYAENPQIANLLLAPYFKQIADDYQQALRDVVAYAVQNGIPVPTFAAAVAYYDSYRAAVLPANLIQAQRDYFGAHTYKRIDKEGVFHTEWLD

SEQ ID NO: 28692 - protein, 134 aa, Escherichia coli
MSVMLQSLNNIRTLRAMAREFSIDVLEEMLEKFRVVTKERREEEEQQQRELAERQEKISTWLELMKADGINPEELLGNSSAAAPRAGKKRQPRPAKYKFIDVNGETKTWTGQGRTPKPIAQALAEGKSLDDFLI

SEQ ID NO: 28693 - protein, 117 aa, Methanopyrus kandleri
MYMIEAVIRPEKLDDVKEALDEAGYPGMTVIHVKGRGRQRGIVHRYRDEEYRTDLLDKILLKVAVPTEDDVEKVIDVICEHAKTGRPGDGMIFVIPLEDAVRARTGERGDDALSTEE

SEQ ID NO: 28694 - protein, 324 aa, Pseudomonas syringae
MSRIYADNAHSIGNTPLVQINRIAPRGVTILAKIEGRNPGYSVKCRIGANMIWDAESSGKLKPGMTIVEPTSGNTGIGLAFVAAARGYKLMLTMPASMSIERRKVLKALGAELVLTEPAKGMKGAIAKAEELLAGDPEKYFMLAQFENPANPAIHEKTTGPEIWADTDGAIDVLVAGVGTGGTITGISRYIKYTAGKPILSVAVEPDGSPIITQAMAGEEIKPSPHKIQGIGAGFIPKNLDLSIVDRVERVTDEESKAMARRLMQEEGILCGISCGAAMAAAVRLAEKPEMQGKTIVVILPDSGERYLSSMLFSDLFTDQELSQ

SEQ ID NO: 28695 - protein, 310 aa, Pseudomonas aeruginosa
MPFPHWSPHTPLQRLELDWLQRAGVELALLRLDQADPLISGNKGFKLAPHLALAREQGLDGLISLGGAHSNHLHALAGAGARFDFRCVGLLRGHEVDTPTVRDLRSLGMELHWLGYGGYRQRHAAGFWLPWRERYPGLLPVAEGGGGLLGARGCIGLVERIATQLPTLGWDDYDAIWVAAGTGTTLAGLVLGEAGRHPVVGALAVPEDHGVAAQVAATLAEAGWADTGYRLLDASRGGFACLDGRLARFIVEFETASGVALEPLYTGKLLLALREAVESGAVARGSRLVALHSGGLQGRRALQERLLALL

SEQ ID NO: 28696 - protein, 209 aa, Unknown
  Azoarcus sp. BH72
MVSWASIFSAACPAMRHADVTRDTLETRISVRIDLDGTGKSVLATGVPFFDHMLDQIARHGAIDLEVRAEGDTHIDDHHTVEDVGITLGQAFAKALGDKKGILRYGHAYVPLDEALSRVVVDFSGRPGLHYFVDYTRARIGNFDVDLAREFFQGFVNHAGVTLHVDNLRGDNAHHQCETIFKAFGRALRMAATRDERLAGAIPSTKGAL

SEQ ID NO: 28697 - protein, 265 aa, Gluconobacter oxydans
MAMPDFTMRQLLEAGVHFGHHTRRWNPAMAPYLFGVRNQVHIIDLQQTVPMLDRALKVVRDTVANGGRVLFVGTKRAAADHVAEAAQRCGQYYVNHRWLGGMLTNWKTITGSIKRLRQIDEMLSGDTAGLTKKEVLDITRDREKLERSLGGIKEMGGLPDLLFVIDTNKEKLAIEEATKLGIPVIGVLDSNSNPAGVTYPIPGNDDAIRAITLYCDLVSGAVLDGISAELAASGQDIGAAEELPAETAVLEAAAAEGAEAPASAG

SEQ ID NO: 28698 - protein, 539 aa, Prochlorococcus marinus
MLFNFPLKNLAKETNRESFRKVLIVRLPCNPIFPIGPIYLADHIHKCFPEIDQQFIDLAIVPLNKVSKYLKRKIDQFRPHIIVYSWRDIQIYAPVDGRSGNPLQNSFEVFYSSNILKKIRGAWGGLKLITSHYEEINRNTSLVKMGLNRAQKYNKSVKVILGGGAVSVFYEQLGKLLPKGTIISVGEGENLIEKVLKGDSIIEERCYLAGQKPRNKLIHEQPSGTIKTACNYKYIKSIWAEFDWYIEGGDYYVGVQTKRGCPHNCCFCVYGVVEGKKVRVNPVNEIIEEMKQLYEMGVRGFWFTDAQFIPTKNHIQDAKLLLQAIKDQGWTDLKWAAYIRADNIDRELAQLMVETGMSYFEIGITSGSQELVRKMQLAYNLKTVLENCRMLVEAGFRNHVSVNYSFNVFDETPNTIKQTVAYHRELENIFGKGLVDPAIFFIGLQPHTLLEKYALENNILKPSYNPMSMMPWTARKLLWNPGPLGKKLGEVCLEAFDNKDDEFGKTVINILERNYGKSSLDDSLKVRKLSERKLTAAKV

SEQ ID NO: 28699 - protein, 142 aa, Oryza sativa
MTTDEELVRPQASGAKNMGFAKFDSMSELHCKIPTVLVHWGLGLMRLKSGWKEMPSIQKALPPELADNVIRLYRECLRRARFIGHQKHNTGLIVSMVREQFKKNMHETDPEKIQKMKDDAARGLINHILYESEKMTGRKFSS

SEQ ID NO: 28700 - protein, 148 aa, Medicago truncatula
MAPKGEKKPAEKKPAEEKKSTVAEKAPAEKKPKAGKKLPKEGGSAAGEKKKKRSKKSVETYKIYIFKVLKQVHPDIGISSKAMGIMNSFINDIFEKLAQESSRLARYNKKPTITSREIQTAVRLVLPGELAKHAVSEGTKAVTKFTSS

SEQ ID NO: 28701 - protein, 148 aa, Medicago truncatula
MAPKGEKKPAEKKPAEEKKSTVAEKAPAEKKPKAGKKLPKEGGSAAGEKKKKRSKKSVETYKIYIFKVLKQVHPDIGISSKAMGIMNSFINDIFEKLTQESSRLARYNKKPTITSREIQTAVRLVLPGELAKHDVSEGTKAVTKFTSS

SEQ ID NO: 28702 - protein, 373 aa, Burkholderia cepacia
MDDVQFQLQQADAREQPSGAYDATTRVAASWYVAMRSDDLKDKPLELTLFGRPCVAWRGAMGRAVVMDRHCSHLGANLADGQVKDGCIQCPFHHWRYDEQGQCVHIPGHSEAVHRLEPVPRGARQPTLVTTERYGYVWVWYGSPQPLHPLPDIAAADVDNGDFMHLHFAFETTTAVLRIVENFYDAQHAHPVHALPISAFELKLCDDWRPWPEVEPLARAGAWFGAGIDFTVNRYFGPLGMLSRALGLSMSQMNLHFDGYPGGCVMTVALDGDAKYKLLQCVTPVSDGRNVMHMLISIRKAGGPVRRAIDYVLFGLQTRQAAGYDVKIWNGMKPDGGGAYSKYDKLVLKYRAFYRGWVDRVASSERQGVSRRS

SEQ ID NO: 28703 - protein, 474 aa, Zea mays
HWAARRGGSTFSSRFAAFYLSHLPSTALSLPLLSRGNWAIAATPTQVFVGRFASRQVFVGPSPGLRPSILRRRAPTRGWELQRGTGSMAGGAGNGSNEAVQAKGSGGDSSAAKPLPPCCVKARAAAPESEAKCHATVVSGWFTEPRSHCGKASKVQYYNNPMWPGEAHSLKVENILYQGKSPYQEVLVFESSTYGKVLVLDGIVQLTDKDECAYQEMITHLPLCSIPSPKKVLVIGGGDGGVLREISRHSSVESIDICEIDQLVIDICKEFFPHLSVGFEDPRVQLHVGDAVEFLRNAPEGTYDAIIVDSSDPIGPAQELVEKPFFETIARALRPGGVLCNQAESMWLHTHLIQDMLSICRETFKGSVRYAWASVPTYPSGVIGFLLCAKDGPPVNFLTPVNPIEEVEGATKAGREIRFYNSEMHMAAFVLPTFAKRELEAYCASTETEQAEEVAATAPQKLTAAPKRGITTAS

SEQ ID NO: 28704 - protein, 184 aa, Triticum aestivum
QAIYLHSTAMAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQCVSFIAFKPPGCEESGKA

SEQ ID NO: 28705 - protein, 382 aa, Vibrio fischeri
MSDVIKNFFKLESAGGILLVIAAAIAMMIANSSLAPMYDTFLHSYIGGMSVSHWINDGLMAVFFLLIGLEVKRELLEGALKSKETAIFPAIAAVGGMLAPALVYVAFNMGDPEALSGWAIPAATDIAFALGIMALLGNRVPVSLKVFLLALAIIDDLGVVVIIAFFYTSDLSVLALVIGFVMTGLLFLLNAKHVTKIRWYLLVGFILWVSVLQSGVHATLAGVVLGFAIPLKGNKGERSPLKHMEHALHPYVAFAILPVFAFANAGISLEGVSLDSLTTTLPLGVALGLFLGKPLGIFSFSYLAVKSGVAKLPTGVNMKHIFAVSVLCGIGFTMSIFISSLAFGGVNPEFDKLARLGILMGSTFAAVVGYALLSISLPKKAA

SEQ ID NO: 28706 - protein, 503 aa, Cryptococcus neoformans
MPPRITSRALSTLSTAQSSAGSSSTLPPSTFSLRQHKRSPSSHSFTFRHFGPLLAHPRNPSTASLGWRRSFHSSTVHPASAKDPYNVLGVNKDASSSDIKKAYYSLAKKWHPDSSKEKDAKEKFHEIQAAYDILSDDKKRQAYDRYGSASTQEGFDPNFAHGAGGFGGFQGFGPGFGDGASDLFESLFGGAFGGGSSAFGGRQRPVRGDDLEVGVNLSFLEACNGVTRKVTVTPVIDCKTCTGSGLKPGEKKSQCPACRGSGQRTFQVQGMVMASTCQTCGGTGSTIPKNARCGECDGVGKVKEKKVLDVEIPAGVEDGMMIRVPGAGDKPLSASGPAGDLLVRVLVKPSSVFRRQGVNLYHDAKVPLHIALLGGVIRIPTLEGDVDVKVKNGTQNGEEAVLKGRGVKSVYGGRRNDRGDLIVGWKVQIPRSLTPFQRKILQAYADDIEGRNPQVHFGPLPSDPPVTSPSSPPKEPTNGETKKEIGEEGRQTKSEEDEVGGKI

SEQ ID NO: 28707 - protein, 202 aa, Corynebacterium efficiens
MTTAPRIGRATRTTSESDITVEINLDGTGTVDIDTGLPFFDHMLTAFGVHGSFDLTVHAKGDIEIDAHHTVEDTAIVLGQALLDAIGDKKGIRRFASCQLPMDEALVEAVVDISGRPYFVINGEPDHMISAVIGGHYATVINEHFFETLALNSRITLHVICHYGRDPHHITEAEYKAVARALRAAVEMDPRQTGIPSTKGAL

SEQ ID NO: 28708 - protein, 121 aa, Oryza sativa
MSERRRREKLNEMFLILKSLVPSIDKVDKASILAEPIPYLKDLERRFQELESGKKMSSPPKRNPCSETIIGGAARAGPGAVKGHHHWVLSESQEGTPSDVRVIIMDKDELHLEVHCRWKEL

SEQ ID NO: 28709 - protein, 1531 aa, Gibberella zeae
MDRANGGGPGAAAAASRAERFEDEKRRIIESCFNKKDVDGSHSVVLETYITHIRITEYSSYPTTPPPPQARNGESQKPRIIIVAVRKSGRVRLHKSKENQNGSFSIGKTWNLDDLSRIESYTGPEARPDYRDWAGDTGFQVTLGKPYFWHAQTDKEKKFFIASLIKIYGKYTGGKTPELAGFEQKEYDQVMGATRRPATGGSRPPPPPLSEQATSQNASAPPRPIHPMHPAAQQGNQGPGIRPPHPNLGPSPVGSFDSSASRERPPAPRWMAQNNKSQDSVATSFTARSDDGSSLPPRSRNGANGPGSYGRFGEAADNRTPSVLTPPQPPSQSQSSPKSQPPSILSPPQPPQSVPSPLQLERPPPERRRPPMDPTRPQDRDLVPPPLISPNKEPMAPPPRSSERVVSRLDNSSQKSANSSYSGSVLEQPKPPPTGRLPDPPKREPLGTPAALRPGSSPSRTPAQTPTSAMGYQQGGPPRANTGSPAPAQGRMPSPSPVRDPSPAAARVPSPAPARVPTPSQANAPSPAAALSPGSGGGGSSDVSPMTVSVPRFGNLQQPPELPKQESPKPVDEPSPGERGAEISDRDSNPSPAISGEEKPGLGPMIKAKKSRNEIAGALWKAASAANAATAFKPRPGGAGERLRLLKSKTEEGPDGISGVVPAPPRPSEQPTPEETPVETPKTEEENKQLEEQKPAEPNKSANRMSLVPEVKITLPTSRPVSVHGPPQEVQKPKEPEKEKPRRSINAGNDMKYLQSLGVNPAILDERSEEFAQWLDYFGWIPGDQMRARNVEEMRADLERELNKAQAGGWLARFREEDERVDAIKAGLDVAMAECEELDNLLTLYSVELSTLSEDIAYIEAQGQGLQVQTANQKLLKKELESLLETCAITSNELDVLRSAPLDDISGLQEVESSLVTLYKAMVKIDPSRTSADQLKVDVTSDTNQGHGLNPDFNQMRIVQEKKQVYDQESAMFIGRFVAFMSRQFDQAFTETKLAMEGALSRKVDSTHHDLGRDTLWQFSPLMLYARDMHGEEWNQVIQIYQDKSQPVYRVEFQAVVAAWRRNARKMTGEEAELLFTSAIEKNQDGGVATTARKLTVKRSGTLARLRSPREDGGNKSKVEKGASDNKDLPYEVFAGVLDDLLPLMQMEQNFIVDFFHATTLEQIDFPDAVAATPPYDRGGTDLRRPRLMEPDRDLARRILRAMEVIFTFLESELLRLMEWVVGQDPLQGIGVLATLEKYIADISQSNQEYLNTLLQKLHGHLEVRFKKFVDEQLRAIEETKVKISKRKGVIAFIRIFPLFSAAVENMLVGVDALAARGTIDREYDRILKTMYDSLMVIARENPSVGIVTTGSADPEDKEALNFHILLIENMNHFLEETETRGLDVLEEWKEKANSTYYEHMNLYLNAVMRRPLGKILEHLENMEAQLQTGKSPASIAAQPSNSKTVFNKVLSNYDSKEIRKGIEALRKRVEKHFGDADDPALSRGLVIKVLSECEQFYEKVERRVGAVTTNVYGGDILFEWPRADVKAAFR

SEQ ID NO: 28710 - protein, 547 aa, Cryptococcus neoformans
MPPRITSRALSTLSTAQSSAGSSSTLPPSTFSLRQHKRSPSSHSFTFRHFGPLLAHPRNPSTASLGWRRSFHSSTVHPASAKDPYNVLGVNKDASSSDIKKAYYSLAKKWHPDSSKEKDAKEKFHEIQAAYDILSDDKKRQAYDRYGSASTQEGFDPNFAHGAGGFGGFQGFGPGFGDGASDLFESLFGGAFGGGSSAFGGRQRPVRGDDLEVGVNLSFLEACNGVTRKVTVTPVIDCKTCTGSGLKPGEKKSQCPACRGSGQRTFQVQGMVMASTCQTCGGTGSTIPKNARCGECDGVGKVKEKKVLDVEIPAGVEDGMMIRVPGAGDKPLSASGPAGDLLVRVLVKPSSVFRRQGVNLYHDAKVPLHIALLGGVIRIPTLEGDVDVKVKNGTQNGEEAVLKGRGVKSVYGGRRNDRGDLIVGWKVQIPRSLTPFQRKILQAYADDIEGRNPQVHFGPLPSDPPVTSPSSPPKEPTNGEGSYPSYRSQNQPQAEHAPHRPSRPPAEPYKPYNPLSSSEEPISLANKLASAIGGAIGWVERFMRGRR

SEQ ID NO: 28711 - protein, 615 aa, Zea mays
MAALATSQLVATPAGLGVPDASTFRRGAAQGLRGARASAAADTLSMRTSARAAPRHQQQARRGGRFPSLVVCASAGMNVVFVGAEMAPWSKTGGLGDVLGGLPPAMAANGHRVMVVSPRYDQYKDAWDTSVVSEIKMGDGYETVRFFHCYKRGVDRVFVDHPLFLERVWGKTEEKIYGPVAGTDYRDNQLRFSLLCQAALEAPRILSLNNNPYFSGPYGEDVVFVCNDWHTGPLSCYLKSNYQSHGIYRDAKTAFCIHNISYQGRFAFSDYPELNLPERFKSSFDFIDGYEKPVEGRKINWMKAGILEADRVLTVSPYYAEELISGIARGCELDNIMRLTGITGIVNGMDVSEWDPSRDKYIAVKYDVSTAVEAKALNKEALQAEVGLPVDRNIPLVAFIGRLEEQKGPDVMAAAIPQLMEMVEDVQIVLLGTGKKKFERMLMSAEEKFPGKVRAVVKFNAALAHHIMAGADVLAVTSRFEPCGLIQLQGMRYGTPCACASTGGLVDTIIEGKTGFHMGRLSVDCNVVEPADVKKVATTLQRAIKVVGTPAYEEMVRNCMIQDLSWKGPAKNWENVLLSLGVAGGAGPLISRVVQRCWDIFLYMLFRLCDMDKYV

SEQ ID NO: 28712 - protein, 512 aa, Shewanella oneidensis
MSVNQNRSGKHALMWFRQDLRLTDNQAFTAACDWVRQHHAAKLKAIYIATPSQWHQHDIAPIQLDFIQRHVNLLAQGLVSLGVEFELIQLDSFRDIPAFLTSYCEEHSIGRVFAGQEPEINEQKRDQACVEAGIPLSLSDEHCLLPPGTVLNLSGDMYRVFTPFSRKWREVAAKQAILPLGVPAPLGSILSEPKPLFFKNIGSTYLAASKDIASSKKGFNQTAPNPLISSEQWAAGEGQAKRLLNQFIQQKVQDYKQDRDFPAIDGTSVISPYLAIGVLSPRQCVAALLQRFPEVIVDDTSPGRTWLNELIWREFYRHLLVAFPDLSKGNNFNRQADHVLWRNNQSEFLAWCEGKTGYPIVDAAMRQLNQTGWMHNRLRMVVASFLTKHLLIDWRWGERYFRQHLIDGDLAANNGGWQWSAGCGCDAQPYFRIFNPMSQSEKFDPDGRFIRKYLPELASWGVTRLHQPNQQKMPSLFEAPLFASQADYPNAIVEHNAARARALTVLGVLKKA

SEQ ID NO: 28713 - protein, 634 aa, Parvularcula bermudensis
MCGIAGIVDLVGEREIPESPLDRMVKALAHRGPDGGGVYRVPGLAFGHRRLAIVDPDQAAQPYIGSEGSVLTYNGEIYNHGELRGDLDRARRPIKTRSDTEILCELMELRGEDALPSLDGMFAFAHWTPRTETLLLVRDRIGEKPLYLAQTPDNFLIFASEIDAILESGLISAEINPTAVADYLLYGYVPDPKTIYRGIGKLPPGHLLKIARGQPIAPAKPWWTLTFKPDDGCLYEAVVEELPLLLDRCVSAQMMSDVPIGAFLSGGLDSGAVTASMQKAATAPVTTCAMGFADPDFDERAAARETATHLCTNHFDWEAPLSPVEDVPRLAAIYGEPFADSSALPTAHLCAGARRHATVALSGDGGDEVFAGYDRYGGILNEARLRQAIPGVVRRSIVTKAGNAFPAFTDRVPKPLRLRTVLQSVGEDHAAAYARAVSAVLPDLSRTLLSEELRDYRPEHHVEEAVYKADTDDPILSAQAADFATWLPGRMLVKIDRASMAVGLEVRPPLLDHRLVEWAARLPRRIKYSEGKGKVILREAIGDRLPKGVSTRAKKGFGSPVDHWFRDQDGSLSRHLLDRTAWRECGFFDQSAVEDLVARHCAGRRNAGQALWSILMFDAFLIRKPSDRTSIASY

SEQ ID NO: 28714 - protein, 289 aa, Oryza sativa
  misc_feature (71)..(71): Xaa can be any naturally occurring amino acid
MALASTSATASAAVLKTPFLGAKRALANAVGVAGAKPAPRRALVVSAKKSWIPAFKSDAEFINPPWLDGSXSSSSLFSSSSSSSSSRRRIVFGWLTTRARLVYLDGSLPGDFGFDPLGLGKDPAFLKWYREAELIHGRWAMAAVLGIFVGQAWSGVPWFEAGAQPEAIAPFSFGSLLGTQLLLMGWVESKRWVDFFNPDSPAVEWATPWSRTAENFSNATGEQGYPGGKFFDPLGLGGETRDGVYIPDTDKLDRLKLAEIKHARLAMLAMLIFYFEAGQGKTPLGALGL

SEQ ID NO: 28715 - protein, 564 aa, Lachancea kluyveri
MSEITLGLYLFERLNQVDVKTIFGLPGDFNLSLLDKIYEVPGMRWAGNANELNAAYAADGYARVKGMSCIITTFGVGELSALNGIAGSYAEHVGVLHVVGVPSVSSQAKQLLLHHTLGNGDFTVFHRMSANISETTAWVTDIATAPAEIDRCIRTTYVTQRPVYLGLPANLVDLMVPASLLDTPIDLSLKPNDPEAEAEVVNSVLELIKDAKNPIILADACASRHDVKPETKQLIDITQFPAFVTPLGKGSIDEQHPRFGGVYVGTLSNDDVKEAVESADLILSVGALLSDFNTGSFSYSYKTKNIVEFHSDYIKIRNATFPGVQMKFALQKLLSEIGAVVKDYKPVAVPPKPTPNPACDPSTPLKQEWVWNQVGRFLQEGDVVITETGTSAFGINQTHFPNNTYGISQVLWGSIGFTTGACLGAACAAEELDKNKRVILFIGDGSLQLTVQEISTMIRWGLRPYLFVLNNDGYTIERLIHGENAQYNEIQPWKNLDLLPTFGAKDYETYRVATTGEWDKLAQDEAFNKNSRIRMVEVMLPVMDAPSNLVKQAQLTASINAKQD

SEQ ID NO: 28716 - protein, 253 aa, Unknown
  Vitis labrusca x Vitis vinifera
MVRAPCCDKVGLKKGPWTTQEDQNLTAYVLQHGHGNWRALPKQAGLLRCGKSCRLRWINYLRPDIKRGNFSREEEDTIIELHEKLGNKWSAIAASLPGRTDNEIKNVWHTHLKKRLKKKLATPDSKGHFTPAASACDSDSFNSSGKMSPQPSSSEFSSFTDSSTRTMETHSTGVKNEQMEEYSPESFPEIDESFWSDALSSDNSSMASDFPAVADELQLQTPELACGQISNMMDDGMEFWYDVFIRAGGLQEL

SEQ ID NO: 28717 - protein, 253 aa, Unknown
  Vitis labrusca x Vitis vinifera
MVRAPCCDKVGLKKGPWTTQEDQILTAYVLQHGHGNWRALPKQAGLLRCGKSCRLRWINYLRPDIKRGNFSREEEDTIIELHEKLGNKWSAIAASLPGRTDNEIKNVWHTHLKKRLTKKLATPDSKGHFTAAASTCDSDSFNSSGKMSPQPSSSEFSSFTDSSTRTMETHSTGVKNEQMEEYSPESFPEIDESFWSDALSSDNSSMASDFPAVADELQLQTPELAYGQISNMMDDGMEFWYDVFIRAGGLQEL

SEQ ID NO: 28718 - protein, 318 aa, Striga hermonthica
MATFPVINMAKLNGEGRPATMAQIEDACQNWGFFEVVNHGISAEFMDRVERLTKEHYKKCMEQRFKEMVAAKGLEAVQSEINDLDWESTFFLRHLPSSNISEIPDLHPEYREVMKEFAAHLEKLAEHLLDLLCENLGLEMGYLKKVFYGSKGPTFGTKVSNYPPCPKPDLIKGLRAHTDAGGIILLFQDDKVSGLQLLKDGQWVDVPPMRHSIVVNIGDQLEVITNGKYKSVMHRVIAQTDGTGRMSLASFYNPGSDAVIYPAPALVEKAENNELYPKFVFEDYMKLYAGLKFQAKEPRFEAFKNMDKAANLGPIATA

SEQ ID NO: 28719 - protein, 1059 aa, Pseudomonas fluorescens
MIAGGAAGALGNYYRVQVEDVYRASIQMQTREQAQDLEQWKSNGFAIGALSILGRHNPSLKRIVLEPEPSADLMERATIPLKTLSLVVEANHAFVLNREGVVVAAHDQHGQTPLGLNVAFRPYFKVALDGGSSVYGAISATTGTRMFYMAAPIFESRTRQDKVIGVLVARFDADRLDASLSKPYSDDLKMILSPSGVVLAASSPAFILKSDRAWPWNRFTGEIRRQFSDYRFANGVPERLPFDAHQSVIQLDGRRYSLSRVDFDWNDPSGPWTLITLGDLDTLLPGEQVLLIEGLSALVFLLLLWGGLRRLADARRHKRDVAQIEQSEQRLDMALQSGALGLWDWNLSLGTVINNDVWLQILGYSKQQMEQAFGHGLERWTALVHPDDYEPVMARLKAHLNDEVGEYRAEYRMRNKEGQWLWVLDIGKIMQRDASGAPARVTGVLQDISERKAVEAQIQQSRQDAERATQAKSEFLDCMSHEIRTPLNAIIGMAHLALDLPLEPVQRDYIEKIDRAAKHLVGTINGVLDLSKIEAGKLSMEQVGFDLRELVDDVLLLVRQRAEEKALRLQLDIPASLPHRYVGDPLRLAQVLTNLVDNAIKFTEAGHVCIGVYLVRQWDHQALLCFSVTDTGVGISDEQQARLFNVFVQADRSISRRYGGSGLGLTISKKIVQLMQGDIRVKSQPGQGATFKFSVQLSLPPLPLEENCATPAAPATGATAGQGAINDPVRWLAGTRVLVVEDNRLNQEVLQGLLQRVGGQVVLAANGAQALRLLLEEGRFDAVLMDCQMPVMDGFATTRKIRGYPHLRWLPIIAVTASSQADVQGRAVAAGMSDLLSKPLEVAAFYRTLVRWIKATDMPVAQVPAPPGTRVLNSTYAGIDTACGLAVVNQDLALHRKLLADFRDSQQQVIERLWQAHAAGDLATLGFLAHSLQGNAGNIGATAVKEAAGQLEEQAGGPAALGPLIEQLARCLEPVLAGLASLPGAADGDLAPQQLGLDPEQVLALERLAKLLSSHNAQALALIDELYEQYPCGPLRAIQERIYRLEFQQAHDLLVDFQG

SEQ ID NO: 28720 - protein, 355 aa, Unknown
  Vitis labrusca x Vitis vinifera
MVTSVAPRVESLSSSGIQSIPKEYIRPQEELTSIGNVFEEEKKDEGPQVPTIDLKDIESEDEVVRERCREELKKAAMEWGVMHLVNHGISDDLINRVKVAGETFFNLPMEEKEKYANDQASGKIAGYGSKLANNASGQLEWEDYFFHLIFPEDKRDMTIWPKTPSDYVPATCEYSVKLRSLATKILSVLSLGLGLEEGRLEKEVGGMEELLLQKKINYYPKCPQPELALGVEAHTDVSALTFILHNMVPGLQLFYEGKWVTAKCVPNSIIMHIGDTIEILSNGKYKSILHRGLVNKEKVRISWAVFCEPPKEKIILKPLPETVSETEPPLFPPRTFSQHIQHKLFRKTQEALLSK

SEQ ID NO: 28721 - protein, 447 aa, Herminiimonas arsenicoxydans
MKHQSLEDFLTHVAERNPGQPEFLQAVTEVMESLWPFIEQNPHYAEHGLLDRLIEPERIIMFRVSWVNDHGDVQVNRGYRIQQNSAIGPYKGGIRFHPSVNLSILKFLAFEQTFKNALTTLPMGGGKGGSDFDPKGKSPGEVMRFCQAFVSELFRHIGSDTDVPAGDIGVGGREVGFMAGMMKKLSNRADCVFTGKGLSFGGSLIRPEATGYGTVYFAEQMLKQKGLSFDGMRVSVSGSGNVAQFAVEKAMSLGAKVITVSDSSGTIVDNDGFTPDKLAILMEVKNHLYGRVSDYAQRTGVEFHAGMSPWHVPVDVALPCATQNELDIEAANILVKNGVICVAEGANMPTTIEAVRVFESSGVLYAPGKASNAGGVATSGLEMGQNAMRISWPREEVDARLHSIMCNIHDACLRHGRRADGTISYVDGANIAGFVKVADAMLAQGVI

SEQ ID NO: 28722 - protein, 489 aa, Saccharomyces cerevisiae
MSADFGLIGLAVMGQNLILNAADHGFTVCAYNRTQSKVDHFLANEAKGKSIIGATSIEDFISKLKRPRKVMLLVKAGAPVDALINQIVPLLEKGDIIIDGGNSHFPDSNRRYEELKKKGILFVGSGVSGGEEGARYGPSLMPGGSEEAWPHIKNIFQSISAKSDGEPCCEWVGPAGAGHYVKMVHNGIEYGDMQLICEAYDIMKRLGGFTDKEISDVFAKWNNGVLDSFLVEITRDILKFDDVDGKPLVEKIMDTAGQKGTGKWTAINALDLGMPVTLIGEAVFARCLSALKNERIRASKVLPGPEVPKDAVKDREQFVDDLEQALYASKIISYAQGFMLIREAAATYGWKLNNPAIALMWRGGCIIRSVFLGQITKAYREEPDLENLLFNKFFADAVTKAQSGWRKSIALATTYGIPTPAFSTALSFYDGYRSERLPANLLQAQRDYFGAHTFRVLPECASDNLPVDKDIHINWTGHGGNVSSSTYQA

SEQ ID NO: 28723 - protein, 168 aa, Xylella fastidiosa
MTSIYTFTFTRLDGRPQALADWRGQVLLLVNVASHCGFTPQYAGLEMLWQRYRDAGLIVIGFPCDQFAGQEPGDEAKIAEFCTLTYGVDFPMAAKIKVNGADAHPLWQWLKHRRRGLFGVAAIKWNFTKFLIGRNGQPIARYSPIKSPEQLEVHIVRALGEEGGGNTH

SEQ ID NO: 28724 - protein, 379 aa, Myxococcus fulvus
MSGNIHQEPERIRQASGVNDLTTQTAASWYVAMRSDALRGKPVAIKLFGQPLVAWRDGGGRPVVMERYCSHLGASLAKGKVVEGCIQCPFHNWRYDSTGACSHVPGHSTEVPRLEPIPPTARQSVYPVMERYGFVWVWYGTKAPLFPLPEMPEAESSESHQSLRFAYETTTSVLRIIENFYDAQHAAPVHQLPISAFELKLFDESSPPPGQEALARDGAWFGAGIDFHVDRYFGPLGVISRTLGLSMSRMQLHFDGYPGGCIMTVSLDGDVKYRLLQCVTPVDKEETVMHMLLAIKKGDGVVRSAANFILYGLQTWAAAGYDVAIWNSMKADGGGAFSKYDQLILKYRAFYRRWVNKVALENSGREKDSRADPRKGAHG

SEQ ID NO: 28725 - protein, 334 aa, Bacillus clausii
MSTVRNIALITSGGDAPGLNGAIAAIAQTPDVNLYFYHGGFDGIIEQDPIAISPTTAREAVQQGELLCFSGRSTHMLHEAGQKRVLEKLKQDCIDALIVCGGNGSAQGARSLSAGLPVAVVPMTIDNDIGGSEYTIGHDTAVNAIAESLHRLRQTAANLPGRIFMVETFGGRCGQLPLAAAVAASADIVLLPEYELNIDKFITEVNARSARGKSVIIVVSEGIYLNKRFSAGDQGVSFALARALEESTGKRVRLSILGYTQRAGDPTSYDCLMAKQMGQCAVDALLNGEKAMLVALKEGRVKAIPLTAIEQAPTLAKELLQLAFKENQLIQLEG

SEQ ID NO: 28726 - protein, 633 aa, Lactobacillus plantarum
MCGLVGCLTDRRKVDNAAYDQVVREMTKMIVHRGPDDEGYFADDNITMGFRRLSIIDLAGGHQPLSYDNERYWLTFNGEIYNYVELREQLIQEGYTFKTDSDSEVILGMYAKYQAKLTTYLRGMFAFVIWDKQEKTLFAARDQFGIKPFYYAIAGDDFYYASESKAIYKILKDKHFDQEALQDYLTFQYVPETETLTKEIKMLAPGCSLTKQLGHAPQIKRYYHWEFHPVVRSEQDYATRLKETLIDSVKIHMRSDVPVGTFLSGGIDSSIVVAIAKQFNPNLKTISVGFERPGYSELDVAQETAAKLNVDNVQMTITPEAFMAAFPHFVWSMDDPLADPAAVPQYFLTKEAVKHVKVCLTGEGADELFGGYTIYHEPESLKAFRYTKPINGALQRIAAMMPAGMRGRSLLMRGTTPLEKRYVGNAFIFNETEKQQFMKHYNRDHSFQQTTRVFYDEAKHYDLISKMQFIDMHTWLNGDLLHNADRTALAHSLELRTPFVDREVFNLAAEIPANLRISHGTTKYILRKAVEDIVPAHVLYRKKLGFPVPIRLWLKDEMYDWAKNIIVTSQTDQYFDKTYFLKLLDDHRAGIRDNSRQLWTVLTFMMWHKLYVEADMLMDSVTANHLAEQVEIG

SEQ ID NO: 28727 - protein, 721 aa, Oceanobacillus iheyensis
MTDSIIAWYDDVHRLIIEHPSSNFLNKPNTPVRITERSTNTHYYNANINHRDEKEIIVELDNPLPIGRDLVLVWNELEIPIYTRKITRTKWFEDNFFTNRKLGAFCNNKSTSFSIWSPVATAVHLQIKNNFYLLDRNQDGSWSISLDGDFHRTTYIYQITINDFTQEVIDPYAKSVTANSTEGVIIDLNRTNALNHQRPNKITKFQDAIIYELHLRDLSTHENSGINNKGNYLGLTESNTVTNLGYSTGRCYINELGITHVQLLPVNDFARVDDLHPNNSYNWGYDPLFFQAPEGSYSSNPTNPLSRINELKSCIDSCHEDNLSVILDVVYNHVFQIDHSSFEKMVPGYFFRYHDNGELSNGTGVGNDFASEKLMARKFILDTIDYFLNEYNVDGFRFDLMGAIDVTTMQEIQKRCQKEKEFILLLGEGWDLPTALPANQKSTPNQAHELTGIAFFNDFFRDTLKGNLFAADSKGYVNGEGMHVEHLPHLVTGCVLSKYGIPFAENPGQIVNYVECHDNHTLWDRLSITNSHFTVDERKKTHQLATAITILSQGIPFLHAGQEWYRTKHGDENSYQSGDNINQLNWSQRETEEESIAFVRTLIELRKRYPVFRLPSVEDINNYVHILPTIHPVFGYTLLDNDADITIYINPTNTCYDLQLPSSANWKVAVSNEFIKRNEQVVIGEQTTLHPYEILVLVKQRSHQKAKNHAIKSYVSQEKGQ

SEQ ID NO: 28728 - protein, 425 aa, Pseudaminobacter salicylatoxidans
MDDLKAAATAATRRGFLKTGLLGGAALAGSLASGRAMAEGDPVITEIQDWNRYPGDGVDARPYGQPSQFESHVVRKNVPWLTSDTISSINFTPLHELEGIITPNGLCFEGHHAGIAEIDRANHRLMINGLVDKPLVFTMADLKRFPGRENRVYFLECAANTGMEWRGSQLNGCQYTHGMIHCVMYTGVRLKHILEEAGVKAAGSWVLAEGADASAMTRSIPMEKALDDCMVAFAMNGEALRPEQGYPIRLVVPGWEGNMWVKWLRRLEVGDQPWQQREETSKYTDLLANGKARRFTWKMDVKSVITSPQVPIVHGKGRTLVSGLAWSGSGTIKRVDVSIDGGRNWHAARIDGPSLPMALHRFYYEFDWDGSEIFLQSRAIDESGFVQPTKDQLRAVRGENSIYHNNGIQTWHVNKDGGVENVEIS

SEQ ID NO: 28729 - protein, 385 aa, Oceanobacillus iheyensis
MSECIGMLLAGGEGKRLGMLTKQGAKPAVPFGGKYRIIDFTLSNCTNSGIQTVGILTQYAPLELNKHIGNGKPWDMNHQHGGVSILPPYTGTKGGDWYSGTADAIYQNMNFIHQYEPEYVLIISGDHIYQMDYQQMLEQHKRTNADVTISVIEVPWAEAGRFGILHANDEQIIYEFEEKPKNPSSNLASMGIYIFNWKTLKKYLIEDANKPNSSRDFGKDIIPSMLNNQHRLYAFKFNGYWKDVGTIQSYWEANMDVLKDNNGYFSLHDRNWRIYTHDSNLPPHFIGTNGKAVNSYINSGSIIYGHIKNSIVFRNVSVQQGSYINQSIIHPNVKIGKDCVLDRVIVMENTTIPEGTIFRSDKEIEPFIINNEILNSMLAPAGGDV

SEQ ID NO: 28730 - protein, 161 aa, Unknown
  Shewanella sp. ANA-3
MTSTIYSHSANDIQGNPTALAQYQGKVILIVNTASECGFTPQYKGLEALYQKYKSQGLVVLGFPCNQFGAQEKADEKGIQSFCELNFGVSFPLFSKIEVNGEHTHPLYQYLKKAAPGVLGTERIKWNFTKFLINRQGEVVARFAPTTKPEAISDKIEALLK

SEQ ID NO: 28731 - protein, 515 aa, Oryza sativa
MGLDLGALVLKSGGLSVSDYDSIVAINIFVALLCSCIVIGHLLEGNRWVNESITALVMGLITGGVILLVSGGKNSHILVFSEDLFFIYLLPPIIFNAGGLGDDWIQVCLIILTFLLNVSKLVSSKEKTILPQFYDNYFIWCCGDIDILCDNLSSTKKPAGQFFSVVELDVKVLNQDETPLLYSLVFGEGVVNDATSVVLFNAIEDIDIANFDSLVLLAFIGNFLYLFFTSTLLGVVAGLLSAYIIKKLCFARHSTDREVAIMILMAYLSYMLSMAHFATLSFIAEIFLFLYVGMDALDIEKWKLASSSPKKPIALSATILGLVMVGRAAFVFPLSFLSNLSKKETRPKISFKQQVIIWWAGLMRGAVSIALAYHKFTASGHTELRINAIMITSTVIVVLFSTMVFGFFTKPLLNLLIPPRPDIAADLSSQSIIDPLLGSLLGSDFDVGQPSPQNNLQLLLTIQTRSVHRVWRKFDDRFMRPMFGGRGFVPFVPGSPVERSIHGSQLGTVTEAEHS

SEQ ID NO: 28732 - protein, 519 aa, Solanum lycopersicum
QGELFLKTRAEELDKEMGLIIRQEETGRHVRMLTHEIRSTLDRHTTLKTTLVELGRTLDLAECALWMPCQGGLTLQLSHNLNNLIPLGSTVPINLPIINEIFSSPEAIQIPHTNPLARMRNTVGRYIPPEVVAVRVPLLHLSNFTNDWAELSTRSYAVMVLVLPMNGLRKWREHELELVQVVADQVAVALSHAAILEDSMRAHDQLMEQNIALDVARQEAEMAIRARNDFLAVMNHEMRTPMHAVIALCSLLLETDLTPEQRVMIETILKSSNLLATLINDVLDLSRLEDGILELENGTFNLHGILREAVNLIKPIASLKKLSITLALALDLPILAVGDAKRLIQTLLNVAGNAVKFTKEGHISIEASVAKPEYARDCHPPEMFPMPSDGQFYLRVQVRDTGCGISPQDIPLVFTKFAESRPTSNRSTGGEGLGLAICRRFIQLMKGNIWIESEGPGKGTTVTFVVKLGICHHPNALPLLPMPPRGRLNKGSDDLFRYRQFRGDDGGMSVNAQRYQRSL

SEQ ID NO: 28733 - protein, 370 aa, Burkholderia pyrrocinia
MNDVQLDQARTEEHPPGVYDATTRLAASWYVAMRSDDLKDKPTELMLFGRPCVAWRGATGRAVVMDRHCSHLGANLADGRVEDGCIQCPFHHWRYDEQGQCVHIPGHSSAVSRLEPVPRGARQPTLVTAERYGYVWVWYGSPQPLHPLPEIAAADVDNGDFMHLHFAFETTTAVLRIVENFYDAQHANPVHALPISAFELKLFDDWRQWPEVESLARAGAWFGAGIDFTVDRYFGPLGMLSRALGLSMSQMNLHFDGYPGGCVMTVALDGDFKYKLLQCVTPVSDGKNVMHMLISIKKVGGALRRATDYVLFGLQTRQAAGYDVKIWNGMKPDGGGAYSKYDKLVLKYRAFYRDWVDRVAEATARPRRRE

SEQ ID NO: 28734 - protein, 346 aa, Corynebacterium efficiens
MGAMRIATLTSGGDCPGLNAVIRGIVRTASNEFGSTVVGYQDGWEGLLADRRVQLYDDEDIDRILLRGGTILGTGRLHPDKFRAGIDQVKANLADAGIDALIPIGGEGTLKGAKWLADNGIPVVGVPKTIDNDVNGTDFTFGFDSAVSVATDAIDRLHTTAESHNRVMIVEVMGRHVGWIALHAGMAGGAHYTVIPEVPFDISEICKRMERRFQMGEKYGIIVVAEGALPKEGTMELREGEVDQFGHKTFTGIGQQIADEVHRRLGHDVRTTVLGHIQRGGTPTAFDRVLATRYGVRAARACHEGQFNTVVALKGERIRMISFDEAVGTLKKVPMERWVTAQAMFG

SEQ ID NO: 28735 - protein, 351 aa, Unknown
  Synechococcus sp. CC9311
MARQYHPDINKEAGAEDRFKEIGRAYEVLSDPQTRGRYDQFGEAGLGGGGGMPDMGDMGGFADIFETFFSGFGGAAGGAGRQRRRGPQQGDDLRYDLTIDFDQAVFGQEREIRIPHLETCTTCGGSGAKSGSGPTTCTTCGGVGQVRRATRTPFGNFEQVAECPSCNGSGQVIADPCSSCGGQGVTQVRKKLRINIPAGVDTGTRLRVSGEGNAGLRGGPSGDLYVFLTVKSHPSLRRDGLTVLSEVKVSYLQAILGDTIEVETVDGPESLDIPAGTQPNSVLSLENKGIPKLGNPVARGHQRISVTVTLPTRLNDEERGLLEDLAGHHSARGEQHHHHKSGLFARLFGQR

SEQ ID NO: 28736 - protein, 372 aa, Kluyveromyces lactis
MAATSDIVEKTHILQKYLELDQRGAIIAEYVWIDSEGGLRSKGRTLNKKVTSVDSLPEWNFDGSSTGQAPGHDSDIYLKPVAFYPDPFRRGDNIVVLAECWNNDGTPNKFNHRHEAAKLFEAHKDAEMWFGLEQEYTLFDQYDQVYGWPKGGFPAPQGPYYCGVGAGKVFARDVIEAHYRACLYAGVNISGINAEVMPSQWEFQVGPCEGIAMADQLWIARYFLHRVAEEFGVKVSLHPKPLKGDWNGAGCHTNVSTKLMRAPGGMKYIEDAIEKLSKRHNEHIKLYGADNEQRLTGRHETASMSTFSSGVANRGASIRIPRSVNKEGYGYFEDRRPASNIDPYLVTGIMCETVCGAIENANMTKEYERESL

SEQ ID NO: 28737 - protein, 358 aa, Pseudomonas putida
MSQFHSLTIKQVRNETRDAVSIAFDVPEHLQAQFRFTQGQYLVMRTQLDNEEVRRSYSICSAVQDGELRVAVKRVPGGRFSAFANEVLKAGQQLEVMPPAGSFFVPLDAARQGNYLGVAAGSGITPILSIIGTTLDSEPHSCFTLLYGNRSSSGALFRDKLEDLKNRYLDRLNLIFVFSREQQDVDLYNGRVDADKCGQLFSRWLDVPGLDAAFICGPQAMTETVRDSLQANGLGKERIHFELFAAAGSETRREAREAAHQVDSALSHITVISDGRALTFDLPRNTQNVLDAGNAIGAELPYSCKAGVCSTCKCRVIEGEVEMDSNHALEDYEVAAGYVLSCQTYPVSDKVVLDFDQL

SEQ ID NO: 28738 - protein, 252 aa, Saccharum officinarum
MGRSPCCEKAHTNKGAWTKEEDERLVAYIRAHGEGCWRPLPKAAGLLRCGKSCRLRWMNYLRPDLKRGNFTDDEDELIIRLHSLLGNKWSLIAGQLPGRTDNEIKNYWNTHIKRKLLARGIDPQTHRALGADAATAPGVAAHHRATAAALLHHAGAAVVVVPAPVKLAAVKPAPAESSSDDGGSSSGSSSGGGAGEPRCPDLNLDLSVGPPAVVADTPTLHLAVCLGYRLCLRPGRFAVTMLKLYCVSIWFY

SEQ ID NO: 28739 - protein, 884 aa, Corynebacterium efficiens
MTSSSEHSYSVWPGDAYPLGSKYDGAGTNFALFSDVAESVELCLVDENDNETRIKLEEKDNNVWHCYLPGILPGQRYGYRVHGPWDPDNGKRCDASKFLVDPYARAFVGEYDGHPSLFSYDIMDPENPHGRNTEDSLPHSMKSVVVSPFFDWGNDQPPRTPYHETVIYEAHVKGMTMTHPDIPENLRGTYAGLAHPKIIEYLVDLGITAIELMPVHQFMQDDRLRELGLRNYWGYNTFGFFAPQNDYSSASTPGAAVAEFKAMVRSFHEAGIEVILDVVYNHTAEGNHMGPTISFRGIDNEAYYRLVDGDERHYMDYTGTGNSLNVRDPHSLQLIMDSLRYWVTEMHVDGFRFDLASTLARELHDVDRLATFFDLVQQDPVVSQVKLIAEPWDIGEGGYQVGNFPPLWTEWNGKYRDTVRDFWRGEPATLGEFASRLTGSSDLYAHNGRRPTASINFVTAHDGFTLNDLVSYNEKHNMANGEDNRDGESHNRSWNCGVEGPTDDPEILQLRAQQRRNFLTTLLLSQGTPMISHGDEMARTQNGNNNVYCQDNELAWINWDQAIEHKDLLSFTRRLLRIRAEHPVFRRRRFLAGGPLGSDVRKRDIAWLVPDGQLMTQDDWDFAFGKSLMVFLNGDAIVEPDYRGQKIEDDSFILMFNAHHEAIDFTLPPEHFGMKWKLLVDTTEAIGYPLEELTIEAGGTLTVPARSSMLLRQIEAPDYTKLDERIAREAREVEEARKRESTDAEAALRASVGAALKAEEEAVQHFTERTKASVGTEGEESEAADTIPGELPEENTGEDTAEESGDADKVSPEVAVEADAEDDSEDDAESDTSTDLGADDKVVHASRADKPAEETETLDEDEELMRKRQAAAQEDDYDSAEDEY

SEQ ID NO: 28740 - protein, 416 aa, Unknown
  Candidatus Pelagibacter ubique HTCC1002
MSRYMRLIGQNARKASLDKVNSKTKNKVLKKYAFLLGKEKKSIFKANQKDIQFALNKGLKSNLIERLTIDEKKLIGIKNSINKIAKLKDPVDATLEKWSRPNGLTISRVSIPIGVIGVVYESRPNVTADVASLCFKSGNAVILKGGSEAINTNKILAKLFRKSLKETRVNENFIQFIDSKDRKMVDFMLSKMKDYIDVIIPRGGKNLVKRVQQFSNVPIIGHLEGLCHTFIDKDANLKMATNVTYNAKLRNTSICGATETILMHEKIVKKFCNPILKKLEENNCKIYGDRFLKKYYKGKIYPAKEKDWSTEYLSSTVSVKTVKDCNGAISHINKYGTMHTDSIITKNKKTANKFLKNVKSSIAMHNTSTQFADGGEFGFGGEVGISTNTLPPRGPVGLWQLVSYKYEIISNGKTRK

SEQ ID NO: 28741 - protein, 509 aa, Ralstonia solanacearum
MHTPITPTGLEGQSELRRRLRARHLTMIALGGAIGTGLFVASGASIAQAGPGGALFTYTLIGVMVYCLMTSLGELAVHLPVSGSFVTYSRLYVEEGFGFALGWNYWFALAVSVAVELAAAQLVMKYWFPGVSGMVWSAAFLLLMFVLNAFSVRGFGEAEYWFSMIKVVTIVVFLLIGLAMIFGIMKGGPQSGWHNFTVGDAPFVGGLPAMIGVAMIAGFSFQGVETIGVAAGEAENPARTIPRGIRQTFWRILLFYVLAILIIAVLLPYTDPNLLRNEATDIGVSPFALVFQHAGLAFAAGMMNAVVLTALLSSGTSSLYVSTRILYDLALEGQAPRWFARVSGNGVPHRALLATSAVGALCFFSSLFGDQVVYLWLLNTSAVTCFIAWFGIALAHYRFRKGFLHQGHTVDQLEYRSPFFPFGPILVAALCVIIILGQNTKALFAPIDNFGAFVATYCGVFLFVAIWLGYRWRYKTRFVRYEQMQFSPRHIRAAQAGDGGAALPGVAAD

SEQ ID NO: 28742 - protein, 512 aa, Ralstonia solanacearum
MSEHTTASAGTPGLRRTLRARHLTMIAIGGSIGTGLFVASGASVSQAGPGGALAAYVLIGTMVYFLMTSLGELAAYMPVPGSFATYGARYVDEGFGFALGWNYWYNWAVTIAVELAAAQLVMHYWFPEVPGVLWSAGFLAVMFLLNAISVRGFGEAEYWFALIKVVTVLCFIAIGLAMIFGIIKGAPASGLHNLTLGEAPFVGGLPAMIGVAMIAGFSFQGTELIGVAAGESADPARTIPRAVRQVFWRILLFYVLAIFIIGALVPYTDPNLLSTEVANIGVSPFTLVFRHAGLAFAAGLMNAVILTAVLSAGNSGMYASTRMLYNLATEGRAPRLFARLSKNGVPRNALLATTAVGALCFLSSLYGDKTVYLWLLNTSGMTGFVAWLGIAISHYRFRKGLVLQGHDPALLPYRSPFFPYGPLFAFGLCLVITLGQNYQAFASGRVDWAEVTATYIGIPIFFAVWLGYRLVRGGGIIRYQDMRFPRPPVTRDPPGEAPAAPGLPAAATSPQR

SEQ ID NO: 28743 - protein, 224 aa, Unknown
  Nostoc sp. PCC 7120
MYKHISFVLSVLLLGGGAATIPSIAQAQVLVVQANNAELKRLLEDGKRLVDAGDYNGAIAVYQQAARMEPRNARIHSGIGYLHAKQGNFQAALAAYRRAIAINPNNSDFFYAVGYIKGNMGDTPGAKEAYRRAIQLNRNNVSAYVGLGITQSRLGDFRSANWAFEQAIKLDRNNAQTYEFMAAMYKQRRQTKQASNLLQKARDLYQRRNDADGVARVEAMLQQL

SEQ ID NO: 28744 - protein, 471 aa, Burkholderia mallei
MGKQAIGVVGLAVMGRNLALNIESRGYAVSVYNRSREKTDELIAEFPDRKLVPAHTLEAFVASLETPRRILLMVKAGEATDATIAALKPLLDKGDVLIDGGNTHFTDTIRRNQELAQAGLHFIGTGVSGGEEGALRGPSIMPGGQRDAYDLVEPILEQIAAKAPADGEPCVAYMGPDGAGHYVKMVHNGIEYGDMQLIAESYAVLKQVAGLTNDELGAVYAEWNQGELDSYLIEITAKIFGKKDDETGEHLVDVILDRAAQKGTGKWTSQNALDLGVPLPLITESVFARVLSSLKAQRVAASEVLSGPSPAPLEGDRAAFVESVRRALYLSKVISYAQGFAQLDTASKEYGWNLDLGTIAKIFRAGCIIRARFLQKITDAYAKNAALANLLLDPYFQDIAANYQSALRDVVIAAVKAGVPVPAFASAVAYFDSYRSARLPANLVQAQRDFFGAHTFERTDKPGSFHASWAE

SEQ ID NO: 28745 - protein, 392 aa, Clostridium acetobutylicum
MSAEKLCENVYWVGVKDQKLRVFDIIMNTKKGSTYNSYLINDDKVAIIDTVKDGFYDEFLKSIKSVIGDKKVDYIVVQHTELDHSGSMYRLIKEYPEAKVVSSKAANMYLKEIVNDEFNSLDAMEVKELNLGKNTLEFISAPNLHWPDTMFTYNKENNILFTCDVMGCHYCPDGSIKDEGGEDYLPEMRYYFDVIMSPFKKFVNMGLDKIKDLKLDMIAPSHGPVHINDIEESVKLYREWAKEKEPKEKNVQIFYITAYGNTGIMAKHLCEDINKKGVKAEVHEITDMKMEDIVELIADANGVLVGSPTINQDAVRPVWDVLSSVCPIVNRGKAAAAFGSYGWSGEGVPMMMDRLKSLKFKTPDNGLKFKFVPASKEFSEADKFVDDFIGLL

SEQ ID NO: 28746 - protein, 443 aa, Corynebacterium glutamicum
MFGLFIATIVAIILKPMPMGAVTIIGMIAAVLTGLVPLTASSDDPGAVYGLIGFSNGTIWLIVMAFLISRGFIKTGLGRRIALFFVSKVGGKMLGVTYGLALADLVLAPAIPSATARGGGIMAPIMKSVALTYDSTPGPTRRRAGAFLALNVGQVNAITCAMFLTAMAGNPLIASLASQMDVNITWTNWAVGAIVPGLVALIVVPWVVYKIYPPELKDTPEVKKMASDELKQLGGFTYGEKVLAGTFVVLLLLWTGGDLVLGISATTTAFVGVIILLVAHVLTWEDIIQEKTAWDTMVWFAVLYMMATALSQYGFIAWISEVIASSLGGMNWVVALVVLVLIYFFSHYFFASATAHISAMYLAFLGAAIAIGAPPLMAALVLAYTSNLFSSLTQYSGGPSPTLFGLNYITVGEWWRTSAIAGAVSITIWLVIGGLWMNVIGLW

SEQ ID NO: 28747 - protein, 239 aa, Synechococcus elongatus
MTSSLSSPGLDLEQLRQRLRSKSDRPRRQAITQLLSLGEPGIEVLKDYLQDCRDRGFDWVAGTIFRELLALQDEAIALYLAEAFPFGLLYLPSEKGIDYQPIQDALIEGDWQEADRLTTVKLCELAGTAAKTRKWLYYTEVLNFPRLDLETIDKLWRVYSEDKFGFSVQRELWLSVDRVWEQLWPRIGWKQGNIWTRYPGAFTWSVEAPRGHLPLTNQLRGARVMAALLEHPAFSEPQP

SEQ ID NO: 28748 - protein, 296 aa, Mycobacterium avium
MTIPWTPDRLGDLTGRRVIVTGATNGVGLGTARALAKAGAEVILAVRNTELGKQRAAQMGGSTAVEKLDLADLSSVRAFADRIEAPVDILINNAGALTDRRTETVDGFEMTLGTNLLGPFALTNLLLPKVRSQIINVGSDAHRSATLHLDDLHLRRHKWTRLGAYAQSKLAVMLWGLELDRRLRAAGSPIVTQLTHPGWVASNLSNLGDAPLKAVAHKAVKVVADRLANDIDEGAAPTLYCISEPIPPGSYVGVSGRFGLRGGPVLIGRTPLACDYDTAARLVAFAERETGTELRV

SEQ ID NO: 28749 - protein, 605 aa, Dianthus caryophyllus
MDTKIGSLDTCPPQNSDICCPNKTTTTATHLHAPPTTHAPPESTLGRHLARRLVQIGVNDVFSVPGDFNLTLLDHLLAEPGLNLVGCCNELNAGYAADGYARSRGVGACVVTFTVGGLSVLNAIAGAYSENLPVICIVGGPNSNDYGTNRVLHHTIGLPDFSQEMRCFQTVTCYQAVVNNLEDAHEQIDTAISTALKESKPVYISVSCNLPAIPHPTFSREPVPFSLSPRMSNKMGLEAAVEAAAEFLNKAVKPVMVAGPKLRVAKACNAFVELVDASGYATAVMPSAKGLVPEHHSHFIGTYWGAVSTAFCAEIVESADAYIFAGPIFNDYSSVGYSLLLKKEKAILVQPDRVVIGNGPAFGCVLMKDFLTELAKKIKKNTTAFENYTRIFVPEGQPLKCEPKEPLRVNVLFQHIQKMLSSDTAVIAETGDSWFNCQKLKLPKGCGYEFQMQYGSIGWSVGATLGYAQAVPEKRVLAFIGDGSFQVTAQDVSTMLRCGQKTIIFLINNGGYTIEVEIHDGPYNVIKNWNYTALIDAIHNGEGKCWTAKVFCEEELVNAIKTATGPKADCLCFIEVIVHKDDTSKELLEWGSRVSAANSRPPNPQ

SEQ ID NO: 28750 - protein, 409 aa, Aspergillus oryzae
MPQQKKQHTVAVIGSGNWGSTIAKILAENTASHPELFTPKVQMWVFEEQIQIPSDSPHHSKYGDKPQNLTEVINAVHENVKYLPGIRLPENVVANPNLEDVVKDATILVFNLPHQFIEKTLDQIKGKHLPYARAISCVKGVDVTDGMVTLFSELIMEKLAIYCGSLSGANIAPEVAAEKFSETTIGYDTPPMDVKAEDGSPEDNKIKIDEQRQVKTRPTHTKLTRVPQELVTVDAELWRTLFGRPYFHVNVVDDVAGVALSGALKNIVALAAGFVAGKGWGENGKAAVIRVGVVEMVKFGRTWFPQSVNERTFTEESAGIADLVASCSAGRNFRSAKHAVEKGVNVDEIEKTEMNGQKLQGTSTAKSVHEFLEKHGKVQDFPLFDAVYGILEGKTSVDSLPKLLDKRFG

SEQ ID NO: 28751 - protein, 320 aa, Burkholderia thailandensis
MSTPKHAKVLILGSGPAGYTAAVYAARANLSPLLITGIAQGGQLMTTTDVENWPADPNGVQGPELMQRFLAHAERFNTEIVFDHIHTAKLHEKPIRLVGDSGEYTCDSLIIATGASAQYLGLPSEEAFMGRGVSACATCDGFFYRGQNVAVVGGGNTAVEEALYLTGIAKKVTVIHRRDKFRAEPILVDRLLEKEKEGTVEIKWDHVLDEVTGDDAGVSGVRIKHVTTGATEDVAVQGLFIAIGHKPNTDIFKGQLEMKDGYIITNGGLSGNATGTSVPGVFAAGDVQDHIYRQAITSAGTGCMAALDAQRYLESLHDHK

SEQ ID NO: 28752 - protein, 333 aa, Mycobacterium avium
MGAGAWGTALAKVLVDAGGPGTEVTLWARRPELAERINATRSNPDYLPGTSLPPGIHATADAGEALRDATTVLLGVPAQAMRANLERWAPLLRDGATLVSLAKGIELGTLMRMSQVIVSVTGVDPAQVAVISGPNLASEIAACQPAATVVACSDSGRAVALQRMLNSGYFRPYTNSDVVGTEIGGACKNVIALACGMAAGVGLGENTAAAIITRGLAEIMRLGIALGAKGATLAGLAGVGDLVATCSSPHSRNRSLGERLGRGATIGSVLAGSPDGGDGHVVEGVTSCQSVLALAASYDVEMPLTDAVHRVCHKGLSVDEAMALLLGRRTKPE

SEQ ID NO: 28753 - protein, 390 aa, Prosthecochloris aestuarii
MRIGVLTGGGDAPGINACLKTIVTQCDEYGFEVFGIKRGWEGLLSLNPDVPDERSLHIVPLTRHLVRKIDRTGGTFLHSSRVNPGNLSRKEVPLFLQCALKRMGRGLINAAHFDATFHVLRVLEHLGLDTLIVIGGDDTISYAWHLQQQGVAVVAIPKTMDNDVFGTDYCIGFGTAVTRSVQYIHQLRTSSGSHERITIVELFGRHTGEACLVSSYLAGVDRTLIPEAPFDPERLADLLIFDKAANTSNYAMVAVSEGARMVGGKFIEYCRHHIDDHVLQRDGIGQLIRDTMTMLTGEEIIWQPLGYLMRSGIPDALDIMVGCNFAQLAVELIRKNVSGVMVALSKGVYDHVPLAVVASGTHQVDIAELYDPEEYRPKMRCVLGKPMFFY

SEQ ID NO: 28754 - protein, 379 aa, Yersinia pestis
MAKRDYYEVLGVSRDAEEREIKKAYKRLAMKFHPDRQSEDKNAEEKFKEAKEAYEILTDAQKRAAYDQYGHAAFEQGGMGGGGFGGGGGGADFSDIFGDVFGDIFGGGRRQQRASRGSDLRYNMDLTLEEAVRGVTKEIRIPTLDECDVCHGSGAKPGSSPVTCPTCHGAGQVQMRQGFFTVQQACPHCHGRGQIIKDPCNKCHGHGRVEKSKTLSVKIPAGVDTGDRIRLSGEGEAGEHGAPSGDLYVQVQVKAHPIFEREGNNLYCEVPINFAMAALGGEIEVPTLDGRVKLKIPAETQTGKMFRMRGKGVKSVRGGSQGDLLCRVVVETPVSLSEKQKQLLRELEESFVGAAGEKNSPRAKSFLDGVKKFFDDLTR

SEQ ID NO: 28755 - protein, 394 aa, Yersinia pestis
MTNIIRQFLRQEAAGGLILIIAAAIALLMANSALQGVYQSFLDIPVSIKIASLDISKPLLLWINDGLMAVFFLMIGLEVKRELMEGSLAGRDKAVFPAIAALGGMLAPALIYLLFNGADEVTRQGWAIPAATDIAFALGVMALLGNRVPTGLKVFLLALAIIDDLGVIIIIALFYTQQVSLQSLGIAAAAIALLAYMNWRGVGKTSAYLLVGLVLWVCILKSGVHATLAGVIVGFMIPLHTQDQRSPSESLEHGLHPWVAYLILPLFAFANAGVSLQGVSLSGLTSLLPMGIATGLFIGKPLGIFTFSWLAVKLGIAKLPDAINFKQIFAVSVLCGIGFTMSIFIASLAFEGTDIALTTYSKLGILLGSTTAAVVGYSLLRLVLPARRKAVNVR

SEQ ID NO: 28756 - protein, 412 aa, Campylobacter jejuni
MKQNDQKENRRDFLKNIGLGLFGISVLSNFSFENFLGSKALAKELPDFKIEGKKDLIYHGEKPLTAETEIYALDSDFTKPENFFVRNNGLPPSLETIKERLHKGWTLEIDGESIINKKSYTIEDLKKKFKTYTYALTVECGGNGRSEVIPSTKGTQWGYGAVACGRWTGVRLKDILKDCGIKNDAVYIGYYGIDTKLNGEETSPISRGVPISKALQDETLIAWAYEGKDIPLVNGYPLRLVCGGYPASTSGKWLYKISVRNKIHDGEKMEGSYKVPVNPVKPGDFNYKGEMKIIESMPIRSVITNIKNGSEIKANKKFEVRGKAWAGELEVSEVYVSNDYGVTWTKAKVEKPLNRLAWQKWSAQISIPTKGYYEIWARAIDSQGNSQPMVLAQWNPGGYINNACHRVNVYGV

SEQ ID NO: 28757 - protein, 311 aa, Mycobacterium smegmatis
MSTSQTVHDVIIIGSGPAGYTAAIYAARAQLKPLVFEGTQFGGALMTTTEVENYPGFREGITGPELMDQMREQALRFGADLRMEDVDAVQLEGPVKTVVVGDETHQARAVILAMGAAARHLGVPGEEALTGMGVSTCATCDGFFFRDQDIVVVGGGDSAMEEATFLTRFARSVTLIHRRDEFRASKIMLERARANEKITFLTNTEITQIEGDPKVTGVRLRDTVTGEESKLDVTGVFVAIGHDPRSELVRGQVELDDEGYVKVQGRTTYTSLDGVFAAGDLVDHTYRQAITAAGSGCAASIDAERWLAEQD

SEQ ID NO: 28758 - protein, 185 aa, Cleome sparsifolia
MNLEEKPAMASRANQSDHLCYVRCNFCSTILAVGIPLTRMLDTVTVKCGHCGNLSFLTTTKPLQGQCLDRHVSLTLQMQSFGGSNELKKGGSSSSSSSSTSSDQPPFPTAAFVVKPPEKKQRLPSAYNRFMREEIQRIKAANPEIPHREAFSAAAKNWAKYIPNSPTSISTGGNAITGLGLGAMK

SEQ ID NO: 28759 - protein, 331 aa, Glycine max
MGRQPCCDKVGLKKGPWTAEEDKKLINFILTNGQCCWRALPKLAGLLRCGKSCRLRWTNYLRPDLKRGLLSEYEEKMVIDLHAQLGNRWSKIASHLPGRTDNEIKNHWNTHIKKKLKKMGIDPVTHKPLSNKTEETQAQPDEQTHQPLQEQQQQQHQHQQQPIPVEKDLKFEPEKEQNREPETSVESSTITEEVKEEDQIMTPLFDSWELMNEFCTDEAPIIEPNEILVPSAPSSASPTTTTISSSTSTSSYSNSSNFLEDLLLPDLEWSDDYNDTNFDNNSSMALWDDDFIGSWNSLINGDGDRKQVFDAPINQYPSVIMDSDSWDYGLF

SEQ ID NO: 28760 - protein, 603 aa, Escherichia coli
MLRPVETPTREIKKLDGLWAFSLDRENCGIDQRWWESALQESRAIAVPGSFNDQFADADIRNYAGNVWYQREVFIPKGWAGQRIVLRFDAVTHYGKVWVNNQEVMEHQGGYTPFEADVTPYVIAGKSVRITVCVNNELNWQTIPPGMVITDENGKKKQSYPHDFFNYAGIHRSVMLYTTPNTWVDDITVVTHVAQDCNHASVDWQVVANGDVSVELRDADQQVVATGQGTSGTLQVVNPHLWQPGEGYLYELCVTAKSQTECDIYPLRVGIRSVAVKGEQFLINHKPFYFTGFGRHEDADLRGKGFDNVLMVHDHALMDWIGANSYRTSHYPYAEEMLDWADEHGIVVIDETAAVGFNLSLGIGFEAGNKPKELYSEEAVNGETQQAHLQAIKELIARDKNHPSVVMWSIANEPDTRPQGAREYFAPLAEATRKLDPTRPITCVNVMFCDAHTDTISDLFDVLCLNRYYGWYVQSGDLETAEKVLEKELLAWQEKLHQPIIITEYGVDTLAGLHSMYTDMWSEEYQCAWLDMYHRVFDRVSAVVGEQVWNFADFATSQGILRVGGNKKGIFTRDRKPKSAAFLLQKRWTGMNFGEKPQQGGKQ

SEQ ID NO: 28761 - protein, 167 aa, Oryza sativa
  misc_feature (27)..(27): Xaa can be any naturally occurring amino acid
FVLGFDNLRSQSVAPPQWTMRNIDDRXNTVTLDNQSSTQDGQEKSVTTQTERKVTVTVENDLVSQAKDEEEDMEALLDTYVMGIGEADAFSERLKQELVALEAANVYQLLQSEPLIDEVLQGLDAASATVDDMDEWLRIFNMKLRHMREDIASIESRNNGLEMQSVN

SEQ ID NO: 28762 - protein, 312 aa, Thermoanaerobacter tengcongensis
MSGRENKIYEDITQLIGNTPMIRLNKVVPENSAEVIVKLESFNPGGSVKDRIALNMIKRAEEEGRLKPGGTIVEPTSGNTGIGLAMVSAVKGYKLILVMPDTMSIERRNLLLSYGAELVLTPGAEGMKGAIKKAQEILELNPDYIMLDQFKNPANPEIHELTTAKEILKDTNGIVDAFVAGVGTGGTISGVGKVLKQYNKDIKIFAVEPEESPVLSGGKPGPHKIQGIGAGFIPDTLNLDVIDEIIKVKERDAFEMSMKLAKQEGILCGISSGANVFAAVEVANRLGKGKRVVTVLPDTGERYLSMHKFFEY

SEQ ID NO: 28763 - protein, 370 aa, Schizosaccharomyces pombe
MGQTLSEPVLDKHSSSGGDRWLHFGVSHMQGWRISMEDAHCALLNFTDSNSSNPPTSFFGVFDGHGGDRVAKYCRQHLPDIIKSQPSFWKGNYDEALKSGFLAADNALMQDRDMQEDPSGCTATTALIVDHQVIYCANAGDSRTVLGRKGTAEPLSFDHKPNNDVEKARITAAGGFIDFGRVNGSLALSRAIGDFEYKKDSSLPPEKQIVTAFPDVVIHNIDPDDEFLILACDGIWDCKSSQQVVEFVRRGIVARQSLEVICENLMDRCIASNSESCGIGCDNMTICIVAFLHGRGLEDWYNWITQRVNSGEGPCAPPSYAELRGPNTIADARNLQLEYDHIASHEYGSGDTYDSDSDDETIAYDRYYLH

SEQ ID NO: 28764 - protein, 757 aa, Burkholderia mallei
MREFDYLLVGGGIASVTAARTLRGEDASASIAILCGEPVLPYQRPPLSQEWLMGAVQPASITLHDAAFYAAQRIDIALGVRAEQLDRAKRIVRTSSGATFRYGKLLIATGASAKAPALPGFGLDGVHVLHTFAQAQALKDAAAHARRATVLGGGFLGVEIAATLQALGLQVTLVERAPGVMPSLRAPALGGHFEALCRARGIDVLTRCEVRRVLGAQCVEAVETSDGGTRPCDLFVAAVGVTPNCGWLDGSGLALGDGVEVDAFLQTADPDVFAAGDVAHFDDPIFGVRRRIEHWDNAVRQGRIAARNMLGHRLPYRDVSIFYGSVFGLSYNLLGYPVGATETIERGAFDEASYMQLYLADDVLRAAFTIDRPAVEIAALNDAIRLHVNVAAHKMKLSDPNYPLDKLPVQTILILQGGGALGAFECGAVKALEQHGVRPDVISAVSIGAFNGAIVASHPKGATKALEAFWRELSIALPLPYESQWREAWLSSYVLSFGVPNFLKPQWSQLGFDADRLRAKWTSFFDATAIEQLIARYVDFDSLGMSPTRLLIGAVDVETGEPRIFDSYVDRLSPAHVLASGSLPPGMPWTVVDGRPYWDGGVVSNSPLDLVIARCGQIGGRVFIVDLFSGSKALPTNLVEVMLRREEIAYMDRVRNDLRFEEYASDFRDLVDGILAHVDAPSANEIRQQPLYIRLMGNRAAIDIARITLNREGRLSFIEDYDFSSDAIAQLQQQGYDAALVALANGRSRRRRGRRRA

SEQ ID NO: 28765 - protein, 338 aa, Burkholderia mallei
MNLQKFSRYPLTFGPTPIQPLKRLSAHLGGKVELYAKRDDCNSGLAFGGNKTRKLEYLIPDALAQGCDTLVSIGGIQSNQTRQVAAVAAHLGMKCVLVQENWVNYHDAVYDRVGNIQMSRMMGADVRLVPDGFDIGFRKSWEDALADVRARGGKPYAIPAGCSDHPLGGLGFVGFAEEVRAQEAELGFQFDYVVVCSVTGSTQAGMVVGFAADGRADRVIGVDASAKPAQTREQILRIAKHTADRVELGRDITSADVVLDERFGGPEYGLPNEGTLEAIRLCAKLEGVLTDPVYEGKSMHGMIEKVRLGEFPAGSKVLYAHLGGVPALNAYSFLFRDG

SEQ ID NO: 28766 - protein, 72 aa, Corynebacterium glutamicum
MAKEGAIEVEGRIVEPLPNAMFRVELDNGHKVLAHISGKMRQHYIRILPEDRVVVELSPYDLTRGRIVYRYK

SEQ ID NO: 28767 - protein, 541 aa, Medicago sativa
MAIEMTSIVSKLSMLSTSDHASVVSMNLFVALLCACIVLGHLLEENRWMNESITALLIGICTGVVILLFSGGKSSHILVFSEDLFFIYLLPPIIFNAGFQVKKKQFFVNFMTITSFGAIGTLISCVIITTGATFAFKRMDIGPLEIGDYLAIGAIFAATDSVCTLQVLNQDETPLLYSLVFGEGVVNDATSVVLFNAIQSFDLNQLNPSIALHFLGNFLYLFVASTLLGVVTGLLSAYVIKKLYIGRHSTDREVALMMLMAYLSYMLAELTYLSGILTVFFCGIVMSHYTWHNVTQSSRITTKHSFATLSFVAEIFIFLYVGMDALDIEKWKFVSDSPGTSIAASSVLLGLILLGRAAFVFPLSFLSNLTKKSQHQKISFRQQVIIWWAGLMRGAVSMALAYNQFTMSGHTQLRSNAIMITSTITVVLFSTVVFGLLTKPLIRLLLPHPKITSSMTTTESTTPKSFIVPLLGDSRDSEADLEGHEIHRPNSLRALLSTPTHTVHRLWRKFDDSFMRPVFGGRGFVPVEPGSPSERNGNQWG

SEQ ID NO: 28768 - protein, 534 aa, Aspergillus oryzae
MSIKSGKDDTIMYQARSDLDEEDPGSQAGSIDPLAAPLKRRLKSRHLQMIAIGGIIGPGLLVGSGNALNKGGPAGCLISFSLVGLIVFFVMQSLGELATAIPVSGSFTEYAQRFVDDALAFGLGWAYWYLWVTILASEYNAISLVIGFWTDAVPQWGWILIFWVLFLGLSNLGVLAYGEMEFWLSLIKVLALLAFFILAICISTGGVGPGPIGFKYYHDPGAFADSINGVARTFVVAGTLYAGTEMVGVTAGESANPQKAVPTAIKQVFWRILIFYIGTFFFLGILLPYNHPKLLSSTSTAASSPLTIALTDAGILPAAHLINALIVISVISAGNGSLYVASRTMLFMARNGKAPRFIDRTNSRGVPWVALIFSNIFTCIVFLTLSSSAGRIYSALITLAGVATFVVWAVICIAHIRFRKAMVVQGDDPSRLPFRAALYPYGTYFALGATIFLVFFQGYTAFLNPFSVDDFIINYILLPVFVMLVVGYKIWNKTKIVKLEEMDIWTGRRVAVIDETETGKEHGWLAKLKDIIIG

SEQ ID NO: 28769 - protein, 327 aa, Arabidopsis thaliana
MALSMEFGFSIGSCFKAPNPPVLISASPNKINFTLRRRKKRFLLRVSAVSYKEFAESALEETRKRIVLEPSHLQYSSMTGLDGKTELQMLAFKSSKIRLLRSMAIENETMQVFDFAGFMEPEYDTPIFCANFFTSTNVNIVVLDLNPLHQLTDQTDYQDKYYNKIMSIYHKYAETFPWGGKLTGESIKFFSPLVMWTRFSSSKEKHKALFSAFLEYYQAWLEMTIQVREEMEPSHVRANCEAQHKYLTWRAQKDPGHGLLKRLVGEAKAKELLRDFLFNGVDELGTKTFIDYFPEYQTEDGTVSDKRSIIGKSYETRPWDLTGQFIG

SEQ ID NO: 28770 - protein, 324 aa, Sulfolobus tokodaii
MMSLLPRAFDVRPGEKFDVVIIGMGPAAYSAALYSARFMLKTLMIGETPGGQLTEAGEVDDYLGLIGIQAADMIKLFNKHIEKYNVPAIMDTVEYFRKENNEFIVKTKRRGEFKADAIIVAVGVKRRKLNVPGEAEFTGKGVSYCSVCDAPLFKNRPVVVVGGGDSALEGAEILSRYATKVYLVHRRDEFKAQPIYVESVKQKPNVEFILNSVVKEIKGDKIVRKVIVQNLKTNEIRELDVNGVFVEIGFDPPTDFARQNGLEVDSHGYIKVDEWMRTNIEGVYAAGDCTGMWLGFRQIITSAAQGAVAAHSAFNYLTEKKRKK

SEQ ID NO: 28771 - protein, 601 aa, Unknown
  Frankia sp. EAN1pec
MSETVTETLESPAEAITARDAEDIFAGWLADFAAALRSGSTSDLAALFLPEATWRDFMAFPWDFHHTVGREETVARLTELAKAWNAADFRPSREQPPVVTDGAINAFFDFTTTDRIDRGYVLLVPSAGHFVVSILQTQVIGLQAHPERVRHHRRDGKVYGIVPDRTRWSSDREKEIAFEDGEPAVLVLGAGHNGLAIAARLGALDVPTLVIDREARVGDTWRKRYASLALHSTVFGDHLPYLSLPPSWPAHTPKDKFADWLESYANLLDLNVWTSTTFLDGHFDEDAQRWTIRVRRGDGSVRELHPRHFVVAGGLFGSPKIPAIKGLETFPGMTAHSDEFQYGADFQGRRALVIGAGVSGHEIAHDLYEHGADVTMLQRSATYVVNYTSYHRYWSTLFTEDMPYTPDFADQMTYALPNERVDELNKKLVKLAAAADQDLLDGLTSRGFKLEWGPDGTGIIGAHMSGKDAYQINIGASELIADGLVHLKQGVEVAEIRERTVVFTDGSTLDVDLIVFATGYHQFWGHIKPTLGSAADRIDKAYGRAADGEYANTWRRSAQPGLWFGTGFIRMARFYTRFTALLIKAIEVGVEPMNPDRADGN

SEQ ID NO: 28772 - protein, 336 aa, Unknown
  Frankia sp. EAN1pec
MTAATSGAGGPATGAGAVAGPGFDRESTALEVARSADLRGRVAVLTGASSGIGVETARALAATGADVVLGVRDVAAGEELVREVRAGATGDIRAERLDLSDLGSVVAFAAQVTGPVDLLIANAGVSRTPESHLPNGLDVRFATNHLGHFLLALRLSEQLAERGARIVVVSSGAHRSIPVRLDDLQWTARRHNPGMAYAESKTANILFAQEATRRWGPDGIFANAVLPGSALTGLQRFHGDEMKRRIGFLNEDGSPNPVLKSPAQAAATTLWAATAPELAGRGGLVLEDCAEALPPGPPGSDVLVRSGFDPSVADPDTARRLWDRSIELLRVLGRPE

SEQ ID NO: 28773 - protein, 177 aa, Lemna gibba
MASSMMASTAAAVARAGPAQSSMVPFNACRSSVPFPATRKANNNLSTLPGNGGRVSCMQVWPPEGLKKFETLSYLPPLSVEDLAKEVDYLLRNDWVPCIEFSKEGFVYRENHASPGYYDGRYWTMWKLPMFGCTDASQVIAEVEEAKKAYPEYFVRIIGFDNKRQVQCISFIAYKPT

SEQ ID NO: 28774 - protein, 180 aa, Solanum lycopersicum
MASSVMSSAAVATRGNGAQASMVAPFTGLKSTASFPVSRKQNLDITSIASNGGRVSCMQVWPPINMKKYETLSYLPDLSDEQLLSEIEYLLKNGWVPCLEFETEHGFVYRENHKSPGYYDGRYWTMWKLPMFGCTDATQVLAEVQEAKKAYPQAWVRIIGFDNVRQVQCISFIAYKPEGY

SEQ ID NO: 28775 - protein, 180 aa, Pisum sativum
MASMISSSAVTTVSRASTVQSAAVAPFGGLKSMTGFPVKKVNTDITSITSNGGRVKCMQVWPPIGKKKFETLSYLPPLTRDQLLKEVEYLLRKGWVPCLEFELEKGFVYREHNKSPGYYDGRYWTMWKLPMFGTTDASQVLKELDEVVAAYPQAFVRIIGFDNVRQVQCISFIAHTPESY

SEQ ID NO: 28776 - protein, 378 aa, Glycine max
  misc_feature (254)..(254): Xaa can be any naturally occurring amino acid
MAVMAVHQFAQCITCHAWSPDQSMVALCPNNNEVHIYRLVEDKWEKVHVLQKHDQVISGIDWSTRSNRIVTASHDRNSYVWNLEGSEWVPTLVILRLNRAALCVQWSPKENKFAVGSGAKTVCICYYEQENNWWVSKLIRKRHDSSVTSVSWHPDNILLATTSTDGKCRVFSTLIKGVDAKDSKKGTSSDSKFGELIVQLDLSSSWTFGVKWSPSGNTLAYAGHNSMIYFVDDVGPSPLAQNVVFRDLPLRDVXVLFVSERKVIGVGFDCNPMVFAADERGIWSFVRYLGERKAASSGPRYGSQFSEAFGKFYGQSKHGVSNDAVETSRARGTVHENCINCIMPLGDHGTLIRRFSTSGLDGRIVVWDLENEQDLLEL

SEQ ID NO: 28777 - protein, 116 aa, Bacillus licheniformis
MSGQMYKVEIVTRPTNFEKLKTELAKIGVTSITFYNVHGCGLQKGHTELYRGVKRESNVYERLKVEIVVSKVPVEKVAETAQNVLKTGEPGDGKIFIYEIKNTINIRTGEEGPDAL

SEQ ID NO: 28778 - protein, 431 aa, Roseovarius nubinhibens
MSDQDQKPRSLREFFAQDPERADREFFGRVANPDRRGFLRNTGLATMAAMVGTSIPFHRNMPIGFVPAAMAQEDVLVGKDGLTLLNDRPVNAETPPELLDDAITPTNRHFIRNNGIPPEEVDAASWTLTIDGFVDTPLELSIQDLRDQFEVVTMALTLECGGNGRAAFDPPAKGNQWTYGAVGCSEWTGVRLKDVLEKAGVQSNVVYTAHYGADTHLSGDPEKLPISRGMPIAKAMTDNILIAFEMNGAELHPMNGAPLRLVVPGWPASTAQKWLTRIELRDVVHDGPKMTGTAYRLPNRPVAPGEKVETEDFVIIERMPVKSLITHPANGAEIGTETEVRGHAWSGDRTVEALEISIDFGTTWQAAELDAPVNSGAWQNWRAQVTFPQAGYYEVWARAKDSAGEMQPFAIDWNPKGYLNNTMHRVGLRVS

SEQ ID NO: 28779 - protein, 406 aa, Shigella boydii
MSKQQIGVVGMAVMGRNLALNIESRGYTVSIFNRSREKTEEVIAENPGKKLVPYYTVKEFVESLETPRRILLMVKAGAGTDAAIDSLKPYLDKGDIIIDGGNTFFQDTIRRNRELSAEGFNFIGTGVSGGEEGALKGPSIMPGGQKEAYELVAPILTKIAAVAEDGEPCVTYIGADGAGHYVKMVHNGIEYGDMQLIAEAYSLLKGGLNLTNEELAQTFTEWNNGELSSYLIDITKDIFTKKDEDGNYLVDVILDEAANKGTGKWTSQSALDLGEPLSLITESVFARYISSLKDQRVAASKVLSGPQAQPAGDKAEFIEKVRRALYLGKIVSYAQGFSQLRAASEEYNWDLNYGEIAKIFRAGCIIRAQFLQKITDAYAENPQIANLLLAPYFKQIADDYQQALRD

SEQ ID NO: 28780 - protein, 579 aa, Corynebacterium efficiens
MVSLVSMLTSLKYRVWAPRPEDVRLHLNGETLPMTRTDGDWWVADREPAVGDRYGFELFDGTEWSKTVPDPRSQYQPDGVHGLSEVISPDFAWSDDAWTGRILPGSVIYELHVGTFSPSGDFDGVIERLDYLKDLGVTAVELMPVQPFGGNRNWGYDGVLWHAVHSGYGGPVGLKKLVDACHNAGIAVYLDVVYNHFGPDGNYNGMFAPYTAGGSTGWGEVVNINGPESDEVRRYILDAVTRWFEEFHIDGLRLDAVHSLDDNGAFPLLEQMTVASEAIAAATGIPRSLIAESDLNDPRLVTSREAGGYGLHAQWVDDIHHALHTLVSGERNGYYSDFGDTATLASTLEKVFHHTGQVSTFRGRRHGREIRRDVTPASRFVTYTTTHDQTGNRAVGDRPSMNLTPAQQMLKAAVIYCSPYTPMLFMGEEYGATTPFAFFCSHTDDELNRLTSEGRKREFARLGWDPETIPTPSEESTFTDSKLDWSFTPEQENILEGYRTLLRLRRELGMSQPDLLSMEISNGPGWISMANGDGILVANFSDSDVEVPFGGELIYSFTSPEVREDSTVLDAYGFAVLRR

SEQ ID NO: 28781 - protein, 593 aa, Paracoccus pantotrophus
MKMTTEEAFVKTLQLHGIEHAFGIIGSAMMPVSDLFPKAGITFWDCAHETNAGMMADGFTRSTGKMSMAIAQNGPGVTGFVTPVKTAYWNHTPLLLVTPQAANRTIGQGGFQEMEQMRIFADCVCYQEEVRDASRIPEVLNRVIMQAWRNSAPAQINIPRDFWTQVIDVELPQVVGFERPAGGEQAVTEAARLLSEAQFPVILSGAGVVLSGAIPDLVRLAERLDAPVCSNYQHNDSFPGSHPLAMGPLGYNGSKAAMEIIAKADVVLALGTRLNPFSTLPGYGIDYWPKEAKIIQVDINADRIGLTKKVTVGIQGDAAKVARGILAQLAPMAGDAGRAERKALVAQTKSRWAQELSSLDHEEDDPGTVWNADARKRDAGLMSPRQAWRAIMQAVPQEAIVSSDIGNNCAIGNAYPSFEAGRKYLAPGLFGPCGYGFPAILGAKIGNPDVPVIGFAGDGAFGISMNEMTACGRDDWPAITMVIFRNYQWGAEKRNTTLWYDNNFVGTELDRDTSYAKIAEACGLRGVQVKSQDELTAALHDAVERQMKNRETTFIEVLLNQELGEPFRRDAMKKPVVVAGIDPADMRPQQGAA

SEQ ID NO: 28782 - protein, 86 aa, Glycine max
  misc_feature (51)..(51): Xaa can be any naturally occurring amino acid
TAARRRQKGDAEGEKVFKGSEVFGDTSPNYLKTILALALWLGTIHFNVALXFGLLFVLMVIPVDEKSKFGRKLSRYICKHVCAYFP

SEQ ID NO: 28783 - protein, 376 aa, Unknown
  uncultured archaeon GZfos36D8
MAGVRDISKAKRIVIKVGTSNLTDKSYRLDPRKVEKLAKEIIELKNKGKEVIVVTSGAIGAGIGKLDLKQRPRDIKVLQATAAVGQNILMSTYDKYFAKYDQTIAQLLLTHDNFFNRQRYLNLRNTLITLLKSGVIPIINENDTVAVDEIKLGDNDNLSALVASSLGADLLIILTDIDGLYTYDPKRSEKAEFISVVEDITPEIERIASGRGKTGVGGMKTKVQAAEVTMKAGIPMIIANGGEKNILSRVIAGEPVGTLFMPKKKRMNDKEHWILFSASPKGKIKVDEGAKTALVEGGGSLLPSGITDVEDEFMRGDPVSIIDSRSVEFARGITNYSSAEIKKIKGVQSKEIEQILGRKDYGYGEVVVYRGNLVLL

SEQ ID NO: 28784 - protein, 75 aa, Mycoplasma hyopneumoniae
MANLPKEQKLLFQGKVTHVFNAQEYEVTLENGIKLNCHIAGKMKIHHIKIIIGDMVKVEISPYDLSKGRIVYRFK

SEQ ID NO: 28785 - protein, 727 aa, Desulfitobacterium hafniense
MTQEVLERSIQVGGRTMTFQTGKIGKQAGGAIFCRYGDTVVSAFATGSAQPREGIDFFPLTVEFEERLYAAGKIPGGFIKREGRPSEKAILSARLIDRPIRPLFPEGYRNDVQVVAQVMSVDQDCASDITGINAASAALTISNVPFEGPVAAVTVGLIGDEFIINPTVEQSEKSVMHLTVAGTKDAVMMVEAGAQEVPEAQMLEAIMFGHREIQRIAEFIENYRLEALERNLAKPKQEVVMKQMPEEIVQAVKAFAYDKMDQAVRTEEKKAREEAIRQVKEEALAHFAEQYPEDSKTIDKILEDFVHKIVRRLITVEHIRPDGRALDEIRPISVEVGILPRTHGTGLFTRGQTQVLTVATLGAVGDEQILDGLGLEESKRYMHHYNFPPYSVGETRPMRGPGRREIGHGALAERALLPVIPDENDFPYTIRLVSEVLESNGSSSMASVCGSTLSLMDAGVPVKSPVAGIAMGLISEENHIAILSDIQGMEDHDGDMDFKVAGTSQGVTALQMDIKIKGVSREILERALTQAKEGRLFILDKMLSVIEKPRPELSPFAPRIITASIHPDKIREVIGPGGKTIKKIIDETGVKIDIEDDGRVFISAVDGEAGENALKIIQALTQEVEVGRIYNGRVTRIMDFGAFVEVIPGVLGLSGKEGLVHISQLAHGRVEKVEDVVKLGDDILVKATGIDKQGRLNLSRKEALPNPNPSSNPNPNGITANRNPRNS

SEQ ID NO: 28786 - protein, 99 aa, Glycine max
MKTGNRFVGIAHAKQKLQRTLSQRIKMASAVADVPKGHLAVYVGENHKRFVIPISYLSHPLFRDLLDWAEEEFGFNHPMGGLTIPCTEDYFISLTSSLN

SEQ ID NO: 28787 - protein, 351 aa, Arabidopsis thaliana
MSSQDSIKMVLKCMLRGAADYLIKPMRKNELKNLWQHVWRRLTLRDDPTAHAQSLPASQHNLEDTDETCEDSRYHSDQGSGAQAINYNGHNKLMENGKSVDERDEFKETFDVTMDLIGGIDKRPDSIYKDKSRDECVGPELGLSLKRSCSVSFENQDESKHQKLSLSDASAFSRFEESKSAEKAVVALEESTSGEPKTPTESHEKLRKVTSDQGSATTSSNQENIGSSSVSFRNQVLQSTVTNQKQDSPIPVESNREKAASKEVEAGSQSTNEGIAGQSSSTEKPKEEESAKQRWSRSQREAALMKFRLKRKDRCFDKKVRYQSRKKLAEQRPRVKGQFVRTVNSDASTKS

SEQ ID NO: 28788 - protein, 267 aa, Unknown
  Mesorhizobium sp. BNC1
MALPDFSMRQLLEAGVHFGHQTHRWNPKMTPYIFGERNNIHIIDLSQTVPLLHQALKVVSDTVGRGGRLLFVGTKRQASDIVADAARRSAQYYVNSRWLGGMLTNWKTISNSIQRLRRLDEMLSSENLGLTKKERLNLERERDKLERALGGIRDMGSTPDMMFVIDTNKEAIAVQEARRLGIPVIAVIDSNCDPDVVDYPIPGNDDAARAIALYCDLIAKAAIDGIERQQGSLGVDIGESAAAPSEPALETASAEATAEGEQPGSQA

SEQ ID NO: 28789 - protein, 644 aa, Oryza sativa
  misc_feature (425)..(425): Xaa can be any naturally occurring amino acid
  misc_feature (442)..(442): Xaa can be any naturally occurring amino acid
MTNSNNGNGGTNAAASGWLGFSLSPHMASSTMDEHHHVHHHQQQQQQQQQQQHHQQQQHGLFFPSVTTAAAAAAYGLAGDVVAATNGYYSQLASMPLKSDGSLCIMEALRRTDQDHHGPKLEDFLGAAQPAMALSLDNTSSFYYGGGGAAAAGHGQHGYLQACDLYGGPAAPSLVTAADEEAAAAAAAMASWVAARGAATAYATGAADANAAENVLPSATAAQHLHHPLALSMSSGSLSSCITAGEYGMAAVAAADGGRKRGGAGGGGQKQPVHHRKSIDTFGQRTSQYRGVTRHRWTGRYEAHLWDNSCKKEGQTRKGRQVYLGGYDMEEKAARAYDLAALKYWGPSTHINFPLEDYQEELEEMKNMTRQEYVAHLRRKSSDPRADASMYRGVTRHHQHGRWQARIGRVSGNKDLYLGTFSTQXSEAADAYDVAAIKFRGXLNAVTNFDITRYDVDKIMASNTLLPADLARRNAATTTSKDDHSAAGAGAIVSVHSAADIAVADTLWKATTAPRQQQQHHDDVVLSGADQAAFSVLHDLVAVDAAAAHQQQQQQQHMSMSAASSLVTSLSNSREGSPDRGGGLSMLFAKPSPAVAASAQQQASTKLMAAPLPLGSWVSSPPASARPPAVSIAHMPLFAAWTDA

SEQ ID NO: 28790 - protein, 550 aa, Yersinia pseudotuberculosis
MFCVQCEQTIRTPAGNGCSYAQGMCGKTAETSDLQDLLVAVLQGLSAWALQARELGIIDSQIDSFAPRAFFSTLTNVNFDSDRIVEYAKDAILLRHSLAVRCRLLDSTITVDHPLAELQLVADDIPSLLQQSQQFALNNDKADVGDDIHGLRMLCLYGLKGAAAYMEHAHVLGQSDEQIYAEYHAYMAWLGTQPRDVDTLLNNAMGIGKMNFNVMAILDQGETQAYGDPQPTSVNVRPVAGKAILISGHDLKDLHMLLEQTQGTGINIYTHGEMLPAHGYPELKRYPHLVGNYGSGWQNQQTEFAKFPGPILMTSNCIIDPNVGNYGDRIWTRSIVGWPGVNHLDGENFAPVIEQALGMAGFPYSELEHLITVGFGRQTLLNAADTVIDLVASKKLRHVFLVGGCDGSRTERSYFTDFARSVPQDCIIMTLACGKYRFNKLDFGTLEGLPRLLDVGQCNDAYAAIMLAVKLSEKLGCTVNDLPLSLVLSWFEQKAIVILLTLLSLGVKNIYTGPTAPGFLTDNLMAILYEKFGMQPITTVEQDMQAILGH

SEQ ID NO: 28791 - protein, 162 aa, Arabidopsis thaliana
  misc_feature (16)..(16): Xaa can be any naturally occurring amino acid
  misc_feature (89)..(89): Xaa can be any naturally occurring amino acid
  misc_feature (132)..(132): Xaa can be any naturally occurring amino acid
  misc_feature (142)..(142): Xaa can be any naturally occurring amino acid
MASSMLSSATMVASPXAQATMVAPFNGLKSSAAFPATRKANNDITSITSNGGRVNCMQVWPPIGKKKFETLSYLPDLTDSELAKEVDYXLSRNKWDSLVVEFELEHGFVYPWSTGNLTRVTMMGRYWNMWKXLPLIGCIESXQVVERKWEKCKKVITPNAFV

SEQ ID NO: 28792 - protein, 1032 aa, Avena sativa
MERARRLANRALLRRLLAGSASTTTPSPSRGISTLVPSPAAGSRPRRARPAHQHTPSRPVSVSALQPSDTFPRRHNSASPAEQTVMASTCGFNTLDSLIDATVPAAIRAPPMQFTGKFDAGFTESQMLEHMAHLASMNKVYKSFIGMGYYNTHIPAVILRNLMENPAWYTQYTPYQAEIAQGRLESLLNYQTMVADLTGLPMSNASLLDEATAAAEAMAMCNGILKAKKKTFLIASNCHPQTIDICQTRAAGFDLNVVVSDAKDFDYSSGDVCGVLVQYPGTEGEVLDYAEFVKDAHKHGVKVVMATDLLALTTLRPPGEIGADIAVGSAQRFGVPMGYGGPHAAFLATSQEYKRLMPGRIIGVSVDSSGKPALRMAMQTREQHIRRDKATSNICTAQALLANMAAMYAVYHGPAGLKAIADRVHGLAGTFAHGLKKLGTVTVQELPYFDTVKITCADANAIAEEARKNEMNLRVVDANTITVAFDETTTLEDVDKLFKVFSGGKPVDFTAESIAPEVSSSIPSSLVRDSPYLTHPIFSMYHTEHELLRYLHKLQTKDLSLCHSMIPLGSCTMKLNATVEMMPVTDPKFANMHPFAPIDQAAGYHEMFDNLGELLNTITGFDSFSLQPNAGASGEYAGLMVIRAYHRARGDHHRNVCIIPVSAHGTNPASAAMCGMKIITVGTDSKGNINIPELKKAAEANKDNLSALMVTYPSTHGVYEEGIDEICRIIHDNGGQVYMDGANMNAQVGLTSPGFIGADVCHLNLHKTFCIPHGGGGPGMGPIGVKKHLAPFLPSHPVIPTGGFPLPEKTDPLGSISAAPWGSALILPISYTYIAMMGSQGLTDASKIAILNANYMAKRLEKHYPVLFRGVNGTVAHEFIIDLRGFKATAGIEPEDVAKRLMDYGFHGPTMSWPVPGTLMIEPTESESKAELDRFCDALISIREEIAQVENGIADVNNNVLKGAPHPPQLLMSDAWTKPYSREYAAFPAAWLRGAKFWPTTCRVDNVYGDRNLICTLQQASQVAEEAAAATA

SEQ ID NO: 28793 - protein, 378 aa, Yarrowia lipolytica
MSHSHPVRRILSPKDLEIFGASDTKKQVFGFVKVLNYYVVGKGNSYETLKHPIIGKLVAILDKVIDLVAKYPPEDATSSRFGKPEFRDFHQALEENAKDWISDLGELEDWQLVELCTYFAASFGDRTRIDFGSGHELNFICFLFCLRQLGLLDVPEYNPEVHDPTGEAKNAKCVEDETDSSAAVLTVFVQYLKTMRAVQASYWLEPAGSHGVWGLDDYHFLPFMFGSAQLACHKYLRPLSIHDMEMLDMWKHEYLYMGCIHFINSVKTTASLRWHSPMLDDISGVKTWAKVNQGMVKMYDAEVLSKLPILQHFMFGQLIKAPEGVSPPPDPNAEVQHIHNHWADCCGIKVPSAIAASEMSQKPGDLRKLRGSGVLPFD

SEQ ID NO: 28794 - protein, 177 aa, Lemna gibba
MASSMMASTAAAVARAGPAQTNMVPFNACRSSVPFPATRKANNDLSTLPSNGGRVSCMQVWPPEGLKKFETLSYLPPLSVEDLAKEVDYLLRNDWVPCIEFSKEGFVYRENHASPGYYDGRYWTMWKLPMFGCTDASQVIAEVEEAKKAYPEYFVRIIGFDNKRQVQCISFIAYKPT

SEQ ID NO: 28795 - protein, 180 aa, Solanum lycopersicum
MASSIVSSAAVATRGNGAQASMVAPFTGLKSTASFPVSRKQNLDITSIASNGGRVSCMQVWPPINMKKYETLSYLPDLSDEQLLSEIEYLLKNGWVPCLEFETEHGFVYRENHKSPGYYDGRYWTMWKLPMFGCTDATQVLAEVQEAKKAYPQAWVRIIGFDNVRQVQCISFIAYKPEGY

SEQ ID NO: 28796 - protein, 475 aa, Triticum aestivum
MALLLLVLVGVVVGVVLASSLLLRWNEVRYGNGRRKDGDGCLPPGTMGWPLFGETTEFLKQGPSFMKQRRLRYGRLFRTHILGCPTVVCMDPELNRRMLLQGESGGLVPGYPQSMLDILGRNNIAAVHGPLHRLMRGAMLGLVRPAALRTSLLPKIDAFMRDHLHGWAGSVVDVQAKTKEMALLSALQQIAGITAGPLSDALKTELCSLVLGTISLPINLPGTSYYQGFQARTKLVSMLEQMIAERRSSGDAHDDMLDALLRSGDDGTREKLTDEQIIDLLIALIYSGYETMSTTSMMAVKYLSDHPRALDELRREHLDIRKGKSPEEAISYEDLKSMAFTRAVISETLRLATVVNGLLRKTTQDVEMNGYVIPKGWRIYVYTREINYDPFMYPDPMTFNPWRWLEKNMESHPHFMLFGGGGRMCPGKEVGTAEIATFLHYFVTRYRWQEEGKNTILKFPRVEAPNGLHIRVQDY

SEQ ID NO: 28797 - protein, 178 aa, Glycine max
MASSMISSPAVTTVNRAGAGMVAPFTGLKSMAGLPTRKTNNDITSIASNGGRVQCMQVWPPVGKKKFETLSYLPDLDDAQLAKEVEYLLRKGWIPCLEFELEHGFVYREHNRSLGYYDGRYWTMWKLPMFGCTDASQVLKELQEAKTAYPNGFIRIIGFDNVRQVQCISFIAYKPPSF

SEQ ID NO: 28798 - protein, 179 aa, Brassica juncea
LRDYMSKFGDLEDCIVMKDRSTGRSRGFGYVTFASSQDAKEALKGEHFLGNRILEVKVATPKEEMRQPAKKVTRIFVARIPPSVSESDFRRHFEKYGEITDLYMPKDHNSKQHRGIGFITFATSDSVEDLMEDTHDLGGTTVAVDRATPKEDDPPPRPPPAARMQRPPVAVAGGFGAPG

SEQ ID NO: 28799 - protein, 248 aa, Zea mays
  misc_feature (198)..(198): Xaa can be any naturally occurring amino acid
AHPSARLASFPTLSDPVALPSSLQPLYYCDYRFLTALSFFGRQQSPGQANPRFASPLSASAPKRGAKRCLCRRRVRPAERDEQQQSRGIALMQGICAVVYRKADNTPCPIKQGLYLGSVGAAFNKDALKSLNITHILIVAKSLDPVFPAEFNYKKIEVLDIPDTDLLKHSDECFGFIDEAISSGGNVLVHCFAGRSRXKHQMSLESALSLVRSKRPQVAPNGGFISQLEKFQKSLQVEQERRMQPVQH

SEQ ID NO: 28800 - protein, 177 aa, Lemna gibba
MASSMMASTAAVARAGPAQSSMVAPFNGLRSSVAFPATRKANNDLSTLPSNGGRVSCMQVWPPEGLKKFETLSYLPPLSVEDLAKEVDYLLRNDWVPCIEFSKEGFVYRENHASPGYYDGRYWTMWKLPMFGCTDASQVIAEVEEAKKAYPEYFVRIIGFDNKRQVQCISFIAYKPT

SEQ ID NO: 28801 - protein, 312 aa, Streptococcus pneumoniae
MAEIYLAGGCFWGLEEYFSRISGVLETSGGYANGQVETTNYQLLEETDHAEAVRVICDEKGVSLREILLYYFRVIDPLSINQQGNDRGRQYRTGIYYQDEADLPAIYTVVQEQERMLGRKIAVEVEQLRHYILAEDYHQDYLRKNPSGYCHIDVTDADKPLIDAANYEKPSQEVLKASLSEESYRVTQEAATEAPFTNAYDQTFEEGIYVDITTGEPLFFAKDKFASGCGWPSFSRPISKELIHYYKDLSHGMERIEVRSRSGSAHLGHVFTDGPRELGGLRYCINSASLRFVAKDEMEKAGYGYLLPYLNK

SEQ ID NO: 28802 - protein, 177 aa, Lemna gibba
MASSMMASTAAVARVGPAQTNMVAPFNGLRSSVAFPATRKANNDLSTLPSNGGRVSCMQVWPPEGLKKFETLSYLPPLSVEDLAKEVDYLLRNDWVPCIEFSKEGFVYRENHASPGYYDGRYWTMWKLPMFGCTDASQVIAEVEEAKKAYPEYFVRIIGFDNKRQVQCISFIAYKPT

SEQ ID NO: 28803 - protein, 180 aa, Nicotiana plumbaginifolia
MASSVLSSAAVATRSNVAQANMVAPFTGLKSAASFPVSRKQNLDITSIASNGGRVQCMQVWPPINKKKYETLSYLPDLSQEQLLSEIEYLLKSGWVPCLEFETERGFVYREHHHSPGYYDGRYWTMWKLPMFGCTDATQVLAEVEEAKKAYPQAWVRIIGFDNVRQVQCISFIAYKPEGY

SEQ ID NO: 28804 - protein, 593 aa, Paracoccus pantotrophus
  misc_feature (83)..(83): Xaa can be any naturally occurring amino acid
MKMTTEESFVKVLQLHGIEHAFGIIGSAMMPVSDLFPRAGITFWDCAHETNAGMMADGFTRSTGRMSMAIAQNGPGVTGFVTXVKTAYWNHTPLLLVTPQAANRTIGQGGFQEMEQMRIFADCVCYQEEVRDASRIPEVLNRVIMQAWRNSAPAQINIPRDFWTQVIDVELPQVVAFERPAGGEQAVAEAAKLLSGAEFPVILSGAGVVLSGAIPELARLAERLDAPVCSNYQHNDSFPGSHPLAMGPLGYNGSKAAMEIIARADVVLALGTRLNPFSTLPGYGIDYWPKDARIIQVDINADRIGLTKKVTVGIQGDAAKVARGILAQLAPTAGDAGRAERKALVAQTRSRWAQELSSLDHEEDDPGTEWNEDARRRDAGLMSPRQAWRAIMQAVPKEAIVSSDIGNNCAIGNAYPSFEAGRKYLAPGLFGPCGYGFPAILGAKIGNPDVPVIGFAGDGAFGISMNEMTACGREDWPAITMVIFRNYQWGAEKRNTTLWYDNNFVGTELDRDTSYAKIAQACGLVGVQVKSQEELTAALHDAVERQMKNRETTFIEVLLNQELGEPFRRDAMKKPVVVAGIDPADMRPQQGAA

SEQ ID NO: 28805 - protein, 531 aa, Burkholderia xenovorans
MNARMPHDTAAPGTSAPVETDIAIIGSGFAGLGMAIRLRQAGIGDFIVAEKADSVGGTWRDNHYPGCACDVQSHVYSFSFAPNPRWTRMFARQPEIRAYLEDCTQRFGVQRHLRFGHELASAIYDETRHRWQLSFTNGQQWSARVLISGMGGLSRAAMPTIPGIENFKGKAFHSQHWDHGYSLQGKRVAVIGTGASAIQFVPQIAPRVAHLDLFQRTPPWIMPKADRRVKPLEQWLFTHLPVTQKIMRSALYCMLESRAFGFAIHPSLMKTAQKVAERHLRRQVRDPLLRAKLTPNYTMGCKRILISNDYFPALSRPNVSVTTTAIARIEEDAVITTDGARHPADCLIFGTGFQVADPFPRGVVRGRGGVDIVDTWRDGAHAYLGTTLPGYPNFFMIVGPNTGLGHNSMVFMIESQVEYILRALKTMNAERADAIEVRPQVERAYNEQIQQKLGRAIWSTGGCKSWYLDPKTGRNTTLWPGFAYKFRQATSTFSMGDYLAYSPAPQPASAPMVPPQPVHAHGSATASAEAT

SEQ ID NO: 28806 - protein, 814 aa, Pseudomonas aeruginosa
MRALNPDVLVVQKRPEGVLPLDELVRRIEGAEPGRKVAFVWVEMDSDKAGRIFYTPPPGQRRGESRWIDPYTGAFVGEPRGEGFFNLMMQLHRFLAMGEYGKQVTAACTLILIFFCLSGLYLRWPRKVFDWRAWLTLDWSRKGRSFNWDLHAVAGTWCLALYLLAALTGLYWSYEWYRNGLFKLLDDAPAGQQAQRGKPGGRGERPADAAPLVVDYAAVWNSIRQAGGDRLQAYNLRLPPAGGQPATVFYRLTDAPHERAFNTLTLDPANGQVKSDQRYSDRSFGSQLLASVYALHVGSYFGMAGRILMMLASLAMPLFFITGWLLYLDRRRKKRAVRASRADLGGSAGASGEPWLIGYASQSGFAEQLAWQSAGQLQAAGLPVRVESLARLDAGQLAEARKALFVVSTFGDGEAPDSARGFERKVLGQAASLDGLSYALLALGDRQYEQFCGFARRMQGWLQGQGARSLFAPVEVDDGDAAALRQWQESLAEVTGGAAPAAWEAPAFEVWSLARRECLNPGSQGESTWLLDLRAPANSAIQWRAGDLLEIVPHQAPVRIREWLQRHNLDGQARVAVEGVEQSLEQALAGRLLPDSFEHLVGLHPQALLDALIPLSVRQYSIASLQSDGDLQLIVRQEQHADGSLGICSGWLTEYLPLGAALTLRLRRNAGFHLPEDDVPLILIGNGTGLAGLRSLLRASIAAGRKRNWLLFGERNFAHDYYCRAELEQALARGELQRLDLAFSRDQAEKIYVQDRLHEAADELRRWIDEGAALYVCGSLQGMAGGVDRVLREVLGEEALQRLADEGRYRRDVY

SEQ ID NO: 28807 - protein, 130 aa, Brassica napus
  misc_feature (76)..(76): Xaa can be any naturally occurring amino acid
  misc_feature (88)..(88): Xaa can be any naturally occurring amino acid
  misc_feature (105)..(105): Xaa can be any naturally occurring amino acid
MIREIPSLQNDNVSIQDHTSSNIKNRNTMDMRRDNRQDMTFRGPTQDQMMSKQEYLQTLSSQNSTRRLITKSSYFXSLESMVVLVGLXASLLFLPLILPPLPPPXPFMLLLVPIGIMVLLMVLALMPSSN

SEQ ID NO: 28808 - protein, 199 aa, Magnetospirillum magnetotacticum
MKRTARVERATSESSVLVELDLDGTGRTEISTTVPFYDHMLTALGKHSLIDLKVVATGDTHIDAHHTVEDVAITIGEALRVALGDKVGIGRFGDATVPLDEALALAVVDVSGRPYLVHSGEPEGQEYHLIGGHFTGSLTRHVLESIAHHAGICIHVRVLAGRDPHHIVEAQFKALARALRAAVAPDPRVEGVPSTKGAL

SEQ ID NO: 28809 - protein, 421 aa, Anabaena variabilis
MTVAALDDCPEPMKSAKRAFQASLKLGTTKGIDRSRAVLAMAQALENAFDDILEANTLDLEASREMAVPELILDWLKLTPTRLEITVEILQRLGEISDPLRRVRNADYQPEDSQSYSQLMPLGVIGFIYEAFPDLGAIAAGLCIKTGNSIILKGSTEASHSNAAIVEALQHAIVEVGLPSGCIELVTTEHGGSLRDLITQDQYINLVIPYGRSSLVQQVVRQATCPVLKSAMGNCYLYWSLNSSLDMVRWMILDSHESEPDPVNAIEKVLIHRQAMPSSLAVLWNSLKEKGFEIKGDGELVEAFPQLQLAKDNEWGNAYLTKTVAFKLVDSLDGAIAWINQYSSGHADSIATESYQESRQFALGVNSASTYINTSPRFSRNPSRGDSVFLGMSNQKGHRRGFISLETLTTLKHIIQGNGRF

SEQ ID NO: 28810 - protein, 117 aa, Arabidopsis thaliana
  misc_feature (83)..(83): Xaa can be any naturally occurring amino acid
  misc_feature (90)..(90): Xaa can be any naturally occurring amino acid
VLVVVDPNRTNQKFNGGVFQPLGEANRERVGFTASVSTVSAVGPVFFLRPTAAIFVPVLGWPPRGKKKGGGGCSLEPKQGTVXVMGAGVXVAAPAVLTAVISNPPMALVDERLSPEG

SEQ ID NO: 28811 - protein, 567 aa, Candida albicans
MSEITLGRFFFERLHQLKVDTVFGLPGDFNLALLDKIYEVEGMRWAGNANELNAGYAADGYARVNPNGLSALVSTFGVGELSLTNAIAGSYSEHVGVINLVGVPSSSAQAKQLLLHHTLGNGDFTVFHRMFKNISQTSAFIADINSAPAEIDRCIRDAYVYQRPVYIGLPSNLVDMKVPKSLLDKKIDLSLHPNDPESQTEVIETVEKLISEASNPVILVDACAIRHNCKPEVAKLIEETQFPVFTTPMGKSSVDESNPRFGGVYVGSLSKPEVKESVESADLILSIGALLSDFNTGSFSYGYKTRNIVEFHSDYTKIRQATFPGVQMKEALQKLLTTVKKSINPNYTPVPVPETKLINTPAAPSTPLTQEYLWTKVSSWFREGDIIITETGTSAFGIVQSRFPKNSIGISQVLWGSIGYTVGATCGAAMAAQELDPKRRVILFVGDGSLQLTVQEISTMCKWECNNTYLFVLNNDGYTIERLIHGEKAQYNDIQPWNNLQLLPLFNAKDYETKRISTVGELNDLFADKAFAVPDKIRMVEVMLPTMDAPANLVAQAKLSEKTNAEQ

SEQ ID NO: 28812 - protein, 322 aa, Oryza sativa
VTIVAKTQPIMDKAIEKVEFLVGREIEVGRTYKGVVSSIKEYGAFVEFNGGQQGLLHISELSHDKVSKVSDVVSVGQVLSLTCIGQDLRGNIKLSLKATLPHAHEKKDLASNHTDPLPSQEVVGWTAVENMPSKDANAEPSISKDEDNMIEETPGCSTPAVIIRSAAECDAQDVTNDPKKKRPKVAKSSPKLSKPASERQEVKRTSAKKTSGASTTAKKNKKEKADSSNDVLDAIPEQNKSNIMNYSSPSNFRSGSMKLGDVVTAKVYQIRAYGLVLELSDGVRGMHKFAENGHKDFEVGEELLVKCSSFNAKGIPVFSLLD

SEQ ID NO: 28813 - protein, 343 aa, Mycobacterium avium
MRIGVLTGGGDCPGLNAVIRAVVRTCDSRYGSSVVGFQDGWRGLLENRRIQLHNDDRNDRLLAKGGTMLGTARVHPDKLRAGLNQIKQTLDDNGIDVLIPIGGEGTLTAAHWLSEENVPVVGVPKTIDNDIDCTDVTFGHDTALTVATDAIDRLHSTAESHQRVMLVEVMGRHAGWIALNAGLASGAHMTLIPEQPFDVEEVCRLVKRRFQRGDSHFICVVAEGAKPIPGSISLREGGIDEFGHERFTGVAAQLGAEVEKRINKEVRVTVLGHVQRGGTPTAYDRVLATRFGVNAADAAHAGEYGQMVSLRGQDIGRVPLADAVRQLKLVPESRYDDAAAFFG

SEQ ID NO: 28814 - protein, 239 aa, Sulfolobus tokodaii
MGKVFIVGAGPGDPELITLKAYNLIKKANVIIYDRLVPKTLLEDTKAELIYVGKEIGDSKLQDYINELLVEKAKTNSIVVRLKGGDPYVFGRGEEECIYVLSHGIECEVVPGVSSAIAVPAYAGIPVTSRLTNSSSFTVITGTRADNKIIDASYIPREGTLIILMGIHVIEQLERVLLSVRDYEEYVAIIENGTTEKQRVITGRLKDLSKLIIEHKIRPPAIIVVGDVVKLREKLWKLT

SEQ ID NO: 28815 - protein, 497 aa, Bordetella parapertussis
MTAPAAVPAPQSPPKVKIPIGLIAGIIAMVVVLLLPLPAELPPAGHRMLAILAFAVVVWITEAVSYEASAIMITTLMAFLLGTAPNVKNPDVLYGTSAAISMALTGFSNSALALVTGALFIAAAMTFTGLDKRIALVTLARVGTSTRRILLGAIAVTIVLSLVVPSATARSAAVVPIMLGVIAAFGVDKRSNIAAGIMIIVAQATSIWNVGIQTAAAQNLLTVGFMDKMLGERVAWSDWLIAGVPWSLLMSAVLIFVVLRLLPPESDAIAGGKEAVEASLRELGPMTSAQKRLMLVSIMLLLFWSTKGKLHKFDTTSTTYFGLVLLMLPRFGVMTWKDVQTRIPWGTVIVFGVGISLGTALLTTQAGQWLGAQVVAHTGLDHLGPLGIFAILSAFLILIHLGFASATALTSAMLPILIAVLQTLPGDFNRLGMTMLLGFVVSYGFILPINAPQNMMALGTETFTAKQFAKVGIVLTIVGYLLMLLMSVTYWRWLGWM

SEQ ID NO: 28816 - protein, 446 aa, Corynebacterium diphtheriae
MARSVVVWFRDDLRVHDNPALMKAWELVRANPADLHAVYIANEVGVRPLGGAVKWWLHHSLLALSEQLAQRGVRLHVLSGDPLTLLPQLVTSCGATAVTMNRRYDPAARSIDDAFVADASAHDVEVYDFPCHLLAEPGEITTTTGGSYKVFTPFSRNLRDAIGDLPLDTLAAPPKAEQPIDDTETQAAIADLGWDAWWAASISKAWTPGEPAAREALAELDDILPRYLDDRDRPDIDGTSRLSPRLRFGELSVAEVWNHAHTSEGFRRQLMWRDFAWHRLDAHPDMATANIRPEFDHFPWDGGDFEAELNAWRHGRTGIALVDAGMRELWATGTMHNRVRMVAASLLVKNLGIHWRHGEQWFWDTLVDADPASNPFNWQWVAGSGDDAAPYFRIFNPDTQARRFDPDGTYRTRWLPIMSADYPEEAIVDLKESRLRALDAYNACKR

SEQ ID NO: 28817 - protein, 214 aa, Hyobanche atropurpurea
NITLEEMLEAGVHFGHGTRKWNPKMAPYISAKRKGIHITNLTRTARFLSEACNLVFDAASRGKQFLIVGTKNKAADSVAWAAIKARCHCVNKKWLGGMLTNWSTTETRLHKFRDLRMEQKAGRLNHLPKRDVAVVKRQLSRLQTYLGGIKYMTGLPDIVIIVDQHEEYMALRECITLGIPTICLIDTNCDPDLADISIPANDDAISSIRLILNK

SEQ ID NO: 28818 - protein, 415 aa, Picrophilus torridus
MEDLDPFTISRQQLQKAAKVMNLDKQALEILSYPREILQVSIPVKMDSGEVKVFTGFRVHYNNARGPTKGGIRYYEKENLSEVMALSAWMTWKTALLDLPLGGAKGGIICNPKELSQGELERLSRGYIDAIADFIGPDKDIPAPDVYTNPQIMAWMMDEYEKVMRRSSPGVITGKPLAVGGSEGRGDATAKGGMYVLREAARSIGLDLSKAKVAVQGFGNAGQYAVKFATEMFGAKVVAVSDSTGGIYAKDGVNYEKLLEHKRKDGTVMNYDGSENISEEEVLEQDVDVLIPAAIEDQIRGDNASKIKAKIILELANGPTTPEADEILYKNNVLVLPDFLSNAGGVTVSYFEWVQNVTGDYWDEETVYSKLDKKMTAATRSVLETSKRYEVDPRTAAYIIAVKKVADAMKARGWY

SEQ ID NO: 28819 - protein, 72 aa, Unknown
  Azoarcus sp. BH72
MAKEDVIEMQGEVTENLPNATFRVKLENGHMVLGHISGKMRMHYIRILPGDKVTVQLTPYDLTKGRIVFRTK

SEQ ID NO: 28820 - protein, 226 aa, Zea mays
MVQCLDGLKHLCAALINCCDADSSKQPTGLENPEVLARETVFSVSEIEALYELFKKISSAVIDDGLINKEEFQLALFKTNKKESLFADRVFDLFDTKHNGILDFEEFARALSVFHPNAPIDDKIEFSFQLYDLKQQGFIERQEVKQMVVATLAESGMNLSDDVIESIIDKTFEEADTKHDGKIDKEEWRNLVLQHPSLLKNMTLQYLKDITTTFPSFVFHSQVDDT

SEQ ID NO: 28821 - protein, 180 aa, Solanum tuberosum
MASSVMSSAAVATRGNGAQASMVAPFTGLKSAASFPVSRKQNLDITSIASNGGRVRCMQVWPPINMKKYETLSYLPDLSDEQLLKEVEYLLKNGWVPCLEFETEHGFVYRENNKSPGYYDGRYWTMWKLPMFGCTDATQVLAEVEEAKKAYPQAWIRIIGFDNVRQVQCISFIAYKPEGY

SEQ ID NO: 28822 - protein, 614 aa, Unknown
  Populus tremula x Populus tremuloides
MISLTDFYHVMTAMVPLYVAMILAYGSVKWWKIFTPDQCSGINRFVALFAVPLLSFHFISTNDPYNMNLRFITADSLQKVIVLVVLALWTKLSKRGCLEWTITLFSLSTLPNTLVMGIPLLKGMYGDYSGSLMVQVVVLQCIIWYTLMLFMFEYRGAKLLISEQFPDTAGSIVSIHVDSDIMSLDGRQPLETEAAIKEDGKLHVTVRKSNASRSDIFSRRSQGLSSTTPRPSNLTNAEIYSLQSSRNPTPRGSSFNHTDFYSMMAAGRNSNFGASDVYGLSASRGPTPRPSNFEEEHGGSNKPRFHHYHAPGGATHYPAPNPGMFSPTTAASKGVSANANNAAAAAAKKPNGQAQQKAEDGRDLHMFVWSSSASPVSDVFGGHDYGAHDLKDVRVAVSPGKVEGQRENQEDYNLERDDFSFGNRGLDRERNSHEGEKGGFDGKPKAMPPTSVMTRLILIMVWRKLIRNPNTYSSLIGLIWSLVSFRWNVKMPLIIAKSISILSDAGLGMAMFSLGLFMALQPRIIACGNSIATFSMAVRFLTGPAIMAAASIAVGIRGTLLHIAIVQAALPQGIVPFVFAKEYNVHPEILSTGVIFGMLIALPITLVYYILLGL

SEQ ID NO: 28823 - protein, 465 aa, Oryza sativa
MAVRLCCCCFLLFVTIAAAGGSLTRTNVATLPGFDGALPSRLETGYVTVDEENGAELFYYFIESEGDPSTDPVLLWITGGDRCSVLSALFFEIGPLKLVIEPYNGSLPRLHYHPYSWTKVASILFVDSPVGAGFSFSRDPKGYDVGDVSASMQLIKLLREWFTEYPHYLSNPFYVGGDSYAGKIVPFIVQKISEDIEAGVRPTFNLKGYLVGNPSTGERIDLESRVPYSHGVGIISDQLYEMIMEHCEGEDYDNPSNVICQQALARFDSLLHEGSRAQILNPNCIYVSPKPNHETIDRKILKEEHGGLKHPPPQPSIKCGVYANYLSYFWANNNFTRRTLGIKKGTINEWVRCHEHDLPYNIDIRSSIKYHRNVTLKGYRALVYCGDHDAVVPFLGTQAWVRSLNYPIVDDWRAWHIDGQSAGFTIAYGNNLTFATVKGAGHTAPEFEPERCFAMFKRWISSIPL

SEQ ID NO: 28824 - protein, 300 aa, Yarrowia lipolytica
MTVKQLEHASIKNSWFTEVSDSFPGQGLMLKVEEILHVSQSEFQDVLVFRSTEYGNVLVLDGVVQVSERDEFAYQEMICHVAMMSHECPKRVLVIGGGDGGVLREIVKHESVEAAHLCEIDESVIELSKKYLPNMAVGFDNTKVTVHIRDGFEFIREVARSDEKYDVIITDSSDPDGPAEKFFQREYFQLLHTALNDDGIVITQSSENVWLNFKFVKQLRDICKGVFASVEYCAALLPTYTSGQLGLMVCSKKPTNLKIPKRQWTQEEESSLVRYYNKEIHEASFVLPNWAKHFLEGTSL

SEQ ID NO: 28825 - protein, 526 aa, Prochlorococcus marinus
MNNDFNSWDKYCNYLWFDKQVNIWLDISKINFTLDQISSLENKFKKVFSALKELEAGAISNIDEKRQVGHYWLRNPSVAPSNLIKDAINNEIRDISEFGEKILEGKITNNKNQKFTNVLWIGIGGSGLGPLLITEALQENSCGLNFSYIDNIDPFLISEKLDELSDKLATTLFVVVSKSGGTPEPKIAMNIIKKHVENKNLDWNSNAIAITMKDSQLYKKAQLENWLKIFNLPDWVGGRTSITSSVGLLPLALINRDVSEFIKGAAIMDDLTRIPNIKDNPAALLSSAWFFSGDGIGKRDMVVLPYRDRLQVFSKYLQQLVMESLGKKFNRKGEIVHQGISVFGNKGSTDQHAYVQQLRDGIDNFFCVFIELLDTPNSNFYFDSENPKEFLSGFLQGTRSALSNENRQSITITLDKLSCLTLGALIALFERAVSFYAELVDINAYDQPGVEAGKKAAAEIIDYQKQVTEIFNNGEELSIKEITSLLRNSSAEPIFFIIRQMCFGNDDYLINGDWSKPSTIRIKKIS

SEQ ID NO: 28826 - protein, 256 aa, Triticum aestivum
  misc_feature (149)..(149): Xaa can be any naturally occurring amino acid
VNSRTSLYKKAGWYRSGIPGISSTHASGGLSMDQAFVQAPEHRTKANLADADGIPVIDLSPLAAGDKAGVDALAAEVGRASQDWGFFVVVRHGVLAETVARALEAQRAFFALPADRKAAVRRDEAAPLGYYESEHTKNVRDWKEVFDLXPREPPPPAAVADGELVFENKWPEDLPRFREALEDYPETMGGAGGSSLLELDPPGAWGLATGTARAWFLSRNQDQPFISGLKPHYSGPWGPKTPRNPSALSGGSGAGP

SEQ ID NO: 28827 - protein, 195 aa, Ralstonia metallidurans
MRVAEVTRNTSETQIRVSLNLDGTGRQKLASGVPFLDHMLDQIARHGMFDLEVEATGDTHIDDHHTVEDVGITLGQAVARAIGDKKGITRYGHSYVPLDECLSRVVIDFSGRPGLEFHVPFTRARVGSFDVDLTIEFFRGFVNHAGVTLHIDNIRGINAHHQCETVFKAFGRALRMAVELDPRAANTIPSTKGTL

SEQ ID NO: 28828 - protein, 180 aa, Solanum tuberosum
MASSIVSSAAVATRANGAQASMVGPFTGLKSTASFPVSRKQNLDITSIASNGGRVRCMQVWPPINMKKYETLSYLPDLSDEQLLKEVEYLLKNGWVPCLEFETEHGFVYRENNKSPGYYDGRYWTMWKLPMFGCTDATQVLAEVEEAKKAYPQAWIRIIGFDNVRQVQCISFIAYKPEGY

SEQ ID NO: 28829 - protein, 103 aa, Triticum aestivum
MDLSDNQIQILERTFKVFLYPDETKRAHLGRELGMQPQQIKFWFKNRRAQMRRATNEQVDNHLSDSENHEIDSENDEIDSENDEIHQDKFAMWVCGWRADPLK

SEQ ID NO: 28830 - protein, 260 aa, Triticum aestivum
MAAEGGSREDRWTLAAATALITGGSKGIGYAIVEELAGFGARVHACSRNAAELEECRRRWEEKGLHVTVSACDVSVRADRERLMDTVRQTFNGKLDILVNNAGQLLVKPTAECTAEEYSKVMATNLESSFHLCQLARPLLVHAGGGSIINMSSIGGSIGFVGSAIYAITKSAMNQLTRSLAAEWAPNNIRVNGVAPGFITTDMIKDMDTESLEREHSKSPLLRSGKPVEIASAVAFLCMPAASFITGQVICVDGGRTISA

SEQ ID NO: 28831 - protein, 180 aa, Solanum tuberosum
MASSVMSSAAVATRGNGAQASMVAPFTGLKSTASFPVSRKQNLDITSIASNGGRVRCMQVWPPINMKKYETLSYLPDLSDEQLLKEVEYLLKNGWVPCLEFETEHGFVYRENNKSPGYYDGRYWTMWKLPMFGCTDATQVLAEVEEAKKAYPQAWIRIIGFDNVRQVQCISFIAYKPEGY

SEQ ID NO: 28832 - protein, 144 aa, Glycine max
  misc_feature (44)..(44): Xaa can be any naturally occurring amino acid
  misc_feature (60)..(60): Xaa can be any naturally occurring amino acid
  misc_feature (89)..(89): Xaa can be any naturally occurring amino acid
DSPKRQQLNGNEINERYRGSPDDLILNHKTGKSLGDIIPCSDEXYSECVQKSGRITTGIXVLIRNKSKKNGDMNEAIYSLYFDDYGNIXAHGTYLTYEDTYLDVTGGSGINEEDDDIIELDASEIPFKLLYTSYLNGHGDLPQE

SEQ ID NO: 28833 - protein, 103 aa, Brassica napus
  misc_feature (21)..(21): Xaa can be any naturally occurring amino acid
  misc_feature (33)..(33): Xaa can be any naturally occurring amino acid
  misc_feature (52)..(52): Xaa can be any naturally occurring amino acid
  misc_feature (54)..(56): Xaa can be any naturally occurring amino acid
  misc_feature (62)..(62): Xaa can be any naturally occurring amino acid
  misc_feature (64)..(65): Xaa can be any naturally occurring amino acid
  misc_feature (68)..(69): Xaa can be any naturally occurring amino acid
  misc_feature (74)..(74): Xaa can be any naturally occurring amino acid
  misc_feature (76)..(76): Xaa can be any naturally occurring amino acid
  misc_feature (79)..(82): Xaa can be any naturally occurring amino acid
  misc_feature (85)..(85): Xaa can be any naturally occurring amino acid
MDAVTDLKRPREEDDNAAAAXTACFSSVIPGWXSEMSPMWPGEAHSLKVEKXLXXXKSDYQXRXXVFXXANLWXKXSCXXXXIRXIGSKPRRLSVTDQPTLPL

SEQ ID NO: 28834 - protein, 308 aa, Streptomyces avermitilis
MADWNTSDIPDQRGRVVVVTGANSGLGYVTARELARKGARVVLACRSEARGAEAGDRLAAELPGAEVELGRLDLGDLGSVRDFAAWFPYERLDLLVNNAGVMALPYGTTADGFETQFGVNHLGHFALTGLLLPTLLGTPGARVVTVSSGMHALANIDIHDLNGERRYRRWIAYARSKTANLLFTHELTRRLAAHGSEVLAAAAHPGYAATNLQTAGVRMEGRRAAERIVELGNRVLAQPAEAGALPVLYAATAPEVRPDSFTGPSFAGWRGAPAPSWRAPWTLNDAMGERLWSASEQLTGVTYEALKV

SEQ ID NO: 28835 - protein, 446 aa, Shigella boydii
MSKQQIGVVGMAVMGRNLALNIESRGYTVSIFNRSREKTEEVIAENPGKKLVPYYTVKEFVESLETPRRILLMVKAGAGTDAAIDSLKPYLDKGDIIIDGGNTFFQDTIRRNRELSAEGFNFIGTGVSGGEEGALKGPSIMPGGQKEAYELVAPILTKIAAVAEDGEPCVTYIGADGAGHYVKMVHNGIEYGDMQLIAEAYSLLKGGLNLTNEELAQTFTEWNNGELSSYLIDITKDIFTKKDEDGNYLVDVILDEAANKGTGKWTSQSALDLGEPLSLITESVFARYISSLKDQRVAASKVLTGPKAQPAGDKAEFIEKVRRALYLGKIVSYAQGFSQLRAASEEYNWDLNYGEIAKIFRAGCIIRAQFLQKITDAYAENPQIANLLLAPYFKQIADDYQQALRDVVAYAVQNGIPVPTFAAAVAYYDSYRAAVLPANLIQAQRD

SEQ ID NO: 28836 - protein, 868 aa, Streptomyces avermitilis
MSTTALVGTGHRPTIVLVGHGMVGQRFLEALAERGLTATHRVVVLCEEPRPAYDRVQLTSYFSGTTPDELSMTDAEFITEHGIDLRLGDPAETVDREARTVTARSGLVIAYDTLVLATGSYPFVPPVPGKDAEGCFVYRTIEDLLAIEAYAKSRATTGAVVGGGLLGLEAAGALKGLGLTSHIVEFAPRLMPVQVDAGGGAALLRTIEDMGLTVHTGTGTQEIVTGDDGAVTGMKLSDGSELATDLVVFSAGVRPRDQLARDCGLPVGERGGIAVDAQCRTEDPHVFAIGECALAADGRVYGLVAPGYEMAETAAATIASADSSFTGADLSTKLKLLGVDVASFGDAHGATAGCLDVVYADSRSGTYKKLVIGRDGELLGGILVGDADAYGTLRALTGSVPPVSPEQLVLPAGGGGGVALGPSALPDSAVICSCHNVTKGAIRGAVTEHSCTTLPEVKKCTKAGTGCGSCVKVLGQLVNDELTASGVEVDHGLCGCFTQTREELYEIVLALRITSYRSLLDRYGREGARGGDGCEVCKPTVGSIIASLAPTIGANGYVLDGEQSALQDTNDHFLANLQKNGSYSIVPRIPGGEITPEKLIVIGEVARDFGLYTKITGGQRIDLFGARVEQLPLIWTRLVDAGFESGHAYGKSLRTVKSCVGQSWCRYGVQDSVRMAIDLELRYRGLRSPHKLKSAVSGCARECAEAQSKDFGIIATANGWNLYVGGNGGATPRHADLLAQDLSDAELVRLIDRFLMFYIRTADRLERTSVWLERIPGGLDHIRDVVVHDSLGICEELESLMTAHVANYRDEWTETINDPEKLARFVSFVNAPDTPDPVVGFVPERDQIKPDLPLLTIGHRPLEGSAQR

SEQ ID NO: 28837 - protein, 98 aa, Bumilleriopsis filiformis
ATYSVTLVNEEKNINAVIKCPDDQFILDAAEEQGIELPYSCRAGACSTCAGKVLSGTIDQSEQSFLDDDQMGAGFLLTCVAYPTSDCKVQTHAEDDLY

SEQ ID NO: 28838 - protein, 957 aa, Escherichia coli
  misc_feature (84)..(84): Xaa can be any naturally occurring amino acid
  misc_feature (151)..(151): Xaa can be any naturally occurring amino acid
  misc_feature (472)..(472): Xaa can be any naturally occurring amino acid
  misc_feature (787)..(787): Xaa can be any naturally occurring amino acid
MTQTLSQLENSGAFIERHIGPDAAQQQEMLNAVGAQSLNALTGQIVPKDIQLATPPQVGAPATEYAALAELKAIASRNKRFTSXIGMGYTAVQLPPVILRNMLENPGWYTAYTPYQPEVSQGRLEALLNFQQVTLDLTGLDMASASLLDEXTAAAEAMAMAKRVSKLKNANRFFVASDVHPQTLDVVRTRAETFGFEVIVDDAQKVLDHQDIFGVLLQQVGTTGEIHDYTALISELKSRKIVVSVAADIMALVLLTAPGKQGADIVFGSAQRFGVPMGYGGPHAAFFAAKDEYKRSMPGRIIGVSKDAAGNTALRMAMQTREQHIRREKANSNICTSQVLLANIASLYAVYHGPIGLKRIANRIHRLTDILAAGLQQKGLKLRHAHYFDTLCVEVADKAGVLARAEAAEINLRSDILNAVGITLDETTTRENVMQLFSVLLGDNHGLDIDTLDKDVAHDSRSIQPAMLRDDXILTHPVFNRYHSETEMMRYMHSLERKDLALNQAMIPLGSCTMKLNAAAEMIPITWPEFAELHPFCPPEQAEGYQQMIAQLADWLVKLTGYDAVCMQPNSGAQGEYAGLLAIRHYHESRNEGHRDICLIPASAHGTNPASAHMAGMQVVVVACDKNGNIDLTDLRAKAEQAGDNLSCIMVTYPSTHGVYEETIREVCEVVHQFGGQVYLDGANMNAQVGITSPGFIGADVSHLNLHKTFCIPHGGGGPGMGPIGVKAHLAPFVPGHSVVQIEGMLTRQGAVSAAPFGSASILPISWMYIRMMGAEGLKKASQVAIXNANYIASRLQDAFPVLYTGRDGRVAHECILDIRPLKEETGISELDIAKRLIDYGFHAPTMSFPVAGTLMVEPTESESKVELDRFIDAMLAIRAEIDQVKAGVWPLEDNPLVNAPHIQSELVAEWAHPYSREVAVFPAGVADKYWPTVKRLDDVYGDRNLFCSCVPISEYQ

SEQ ID NO: 28839 - protein, 294 aa, Desulfitobacterium hafniense
MKFTLEMKLKDIMAANPKTVEAMQELGLHCLGCPFSVNETLLNAAQMHKLDPEKLLEAVNSVEQGEMSEAAKAKAQPKGAILQMDKKTFAIAPHIPAGVATPEILRKIADVAEKYNAAAIKVTSAQRIAIVGLKPEVIPAAWDDLGMDPGHAIGLCVRSVKVCPGMTFCKRGLQETLGIGMEVDKRYHGMSLPAKFKIGIAGCPNKCTDSMNVDLGIMGTSKGYHVYVGGNGGVKPRRGDLLLENLQSDQLIPVIDAVMEYFKENAKPQERLGRLIDRVGLEGLQEAAQDVVNA

SEQ ID NO: 28840 - protein, 147 aa, Unknown
  Candidatus Pelagibacter ubique HTCC1002
MEIAVLGLGCFWGPEIKFSKLEGVIKTEVGYCGGDSKTVTYKEVCTGNTNHAEVVKLDFDPKIISYEKILDFFFEIHDPTTLNSQGPDFGTQYRSEIFYLSDRQKEIAESVIKKVNLKLSGNVVTKSSLLKNYCPAEEYHQRYLEKR

SEQ ID NO: 28841 - protein, 437 aa, Medicago sativa
MALTQLNNTCSKTQLHSSSQLSFLSRTLPRHHHCTLAPLHRTQHARISCSVAPNQVQAPAVQTQDPKSKPDCYGVFCLTYDLKAEEETKSWKKLITIAVSGAAGMISNHLLFKLASGEVFGPNQPIALKLLGSERSLQALEGVAMELEDSLFPLLREVVISIDPYEVFQDAEWALLIGAKPRGPGMERAALLDINGQIFAEQGKALNAVASRNVKVIVVGNPCNTNALICLKNAPNIPAKNFHALTRLDENRAKCQLALKAGVFYDKVSNMTIWGNHSTTQVPDFLNARIDGLPVKEVIKDHKWLEEEFTEKVQKRGGALIQKWGRSSAASTSVSIVDAIRSLIIPTPEGDWFSTGVYTTGNPYGIAEDIVFSMPCRSKGDGDYELVKDVIFDDYLRQKLAKTEAELLAEKKCVAHLTGEGIAVCDLPGDTMLPGEM

SEQ ID NO: 28842 - protein, 203 aa, Zea mays
LTHSGVGSSSTQLLHKQSHHHPNPNTSALAPDWDAPAGEGLALAQFAAGCFWSVELVYQRLPGVARTEVGYSQGHRHAPTYRDVCGNGTGHAEVVRVHYDPNACPYDVLLDVFWAKHNPTTLNRQGNDVGTQYRSGIYYYTTEQETLARESLAAKQKEWQDAIVTEVLPARRFYPAEEYHQQYLEKGGQSAKKGCSDPIRCYG

SEQ ID NO: 28843 - protein, 571 aa, Legionella pneumophila
MNSEVDTLFAQAYKLQYEGHLPQAISLYEQILAQSPKHTETLHFLGLTYAQLGDMENAILYFLQARKINPNDVGILNNLANAYKKAGQLDEAIKYYQQAIEIKPEYVQAHNNLAATYALLNNYQKALHHYVIAVNTEPDFSAAHFNLGLLLLKNQQLSAAKTQFNNVIALNPQHREAQFYLGILHLEDNLLSEAEQAFHKVLEQDHEHVQSLINLGVIALKREQNQLAVDYFTKALALDNEDIDARNNLAATFMHHDRFENALMHYDVLLKKEPDNLEYLYNSGVAQMALGHLNEATLLFDQILTLQSDHTPSLNNLAAIYLKMDMRETAREYLERALAINPDDVISRHMLNAITGATSVNTTEKYAQNLFNNYALYYDQHMQGELHYKIPHHIGRLIHQLQLLQTSHSLDLGCGTGLTGIVLREISKHLTGVDIAEKMIARAKEKNIYDLLVCSELIDFLRKDKNDYDLAVAADVLPYFGNLDDIFNSINQHLKQEGYFIFTTEISTTTPWKLESSARFSHQPEYIESLINKYQFHLIKQEKIPGRTQNKQVLEVMLYCIQKSTSCFVSN

SEQ ID NO: 28844 - protein, 236 aa, Platanus occidentalis
MTRRYWNINLEEMMEAGVHFGHGTRKWNPRMAPYISAKRKGIHIINLTRTARFLSEACDLVFDAARRGKRFLIVGTKNKVVDLVASAAIRARCHYVNKKWLGGMSTNWSTTETRLHKFRDLRAEQKAGRLNHLPKRDAAMLKRQLSHLETYLGGIKYMTGLPDIVIIVDQQEEYTALRECVTLGIPTICLIDTNCDPDLADISIPANDDAIASIRLVLNKLVSAICEGRSSYIRNH

SEQ ID NO: 28845 - protein, 392 aa, Chlamydophila caviae
MDYYDVLGVSKTASPEEIKKSYRKLAVKYHPDKNPGDAEAEKRFKEVSEAYEVLSDPQKRESYDRYGKNGPFAGAGGFGGMGGMGNMEDALRTFMGAFGGEFGGGGSFFEGLFGGLGEAFGMRGDPAGARQGASKKVHITLTFEEAARGVEKELLVSGYKTCETCLGSGAASEQGIKCCDRCKGSGQIVQSRGFFSMASTCPECGGEGRVITDPCSNCRGQGRIKDKRNVHVQIPAGVDSGMRLKMEGYGDAGQNGAPSGDLYVFIDVEAHPVFERRGDDLILELPIGFVDAALGMKKEIPTLLKEGMCRLTVPEGIQSGTILKVKNQGFPNVHGRGRGDLLVRVSVETPQNLSEEQKELLRKFATTEKAENFPKKRGFLDKIKGFFSDFAV

SEQ ID NO: 28846 - protein, 478 aa, Shigella flexneri
MTRIKINARRIFSLLIPFFFFTSVHAEQTAAPAKPVTVEAKNETFAPQHHDQYLSWKATSEQSERVDALAEDPRLVILWAGYPFSRDYNKPRGHAFAVTDVRETLRTGAPKNAEDGPLPMACWSCKSPDVARLIQKDGEDGYFHGKWARGGPEIVNNLGCADCHNTASPEFAKGKPELTLSRPYAARAMEAIGKPFEKAGRFDQQSMVCGQCHVEYYFDGKNKAVKFPWDDGMKVENMEQYYDKIAFSDWTNSLSKTPMLKAQHPEYETWTAGIHGKNNVTCIDCHMPKVQNAEGKLYTDHKIGNPFDNFAQTCANCHTQDKAALQKVVAERKQSINDLKIKVEDQLVHAHFEAKAALDAGATEAEMKPIQDDIRHAQWRWDLAIASHGIHMHAPEEGLRMLGTAMDKAADARTKLARLLATKGITHEIQIPDISTKEKAQQAIGLNMEQIKAEKQDFIKTVIPQWEEQARKNGLLSQ

SEQ ID NO: 28847 - protein, 148 aa, Yersinia pestis
MPERRAKCKQREIMRLLHTMLRVGDLQRSIDFYTKVLGMRLLRTSENTEYKYSLAFVGYSDESKGSVIELTYNWGVDQYDMGTAFGHLALGVDDVAATCDQIRQAGGKVTREAGPVKGGNTIIAFVEDPDGYKIELIENKSAGDCLGN

SEQ ID NO: 28848 - protein, 1044 aa, Arabidopsis thaliana
MERARRLAYRGIVKRLVNETKRHRNGESSLLPTTTVTPSRYVSSVSSFLHRRRDVSGSAFTTSGRNQHQTRSISVDALKPSDTFPRRHNSATPDEQAQMANYCGFDNLNTLIDSTVPKSIRLDSMKFSGIFDEGLTESQMIEHMSDLASKNKVFKSFIGMGYYNTHVPPVILRNIMENPAWYTQYTPYQAEISQGRLESLLNYQTVITDLTGLPMSNASLLDEGTAAAEAMAMCNNILKGKKKTFVIASNCHPQTIDVCKTRADGFDLKVVTVDIKDVDYSSGDVCGVLVQYPGTEGEVLDYGEFVKNAHANGVKVVMATDLLALTMLKPPGEFGADIVVGSGQRFGVPMGYGGPHAAFLATSQEYKRMMPGRIIGVSVDSSGKQALRMAMQTREQHIRRDKATSNICTAQALLANMTAMYAVYHGPEGLKSIAQRVHGLAGVFALGLKKLGTAQVQDLPFFDTVKVTCSDATAIFDVAAKKEINLRLVDSNTITVAFDETTTLDDVDKLFEVFASGKPVQFTAESLAPEFNNAIPSSLTRESPYLTHPIFNMYHTEHELLRYIHKLQNKDLSLCHSMIPLGSCTMKLNATTEMMPVTWPSFTNMHPFAPVEQAQGYQEMFTNLGELLCTITGFDSFSLQPNAGAAGEYAGLMVIRAYHMSRGDHHRNVCIIPVSAHGTNPASAAMCGMKIVAVGTDAKGNINIEELRNAAEANKDNLAALMVTYPSTHGVYEEGIDEICNIIHENGGQVYMDGANMNAQVGLTSPGFIGADVCHLNLHKTFCIPHGGGGPGMGPIGVKQHLAPFLPSHPVIPTGGIPEPEQTSPLGTISAAPWGSALILPISYTYIAMMGSGGLTDASKIAILNANYMAKRLESHYPVLFRGVNGTVAHEFIIDLRGFKNTAGIEPEDVAKRLMDYGFHGPTMSWPVPGTLMIEPTESESKAELDRFCDALISIREEISQIEKGNADPNNNVLKGAPHPPSLLMADTWKKPYSREYAAFPAPWLRSSKFWPTTGRVDNVYGDRNLVCTLQPANEEQAAAAVSA

SEQ ID NO: 28849 - protein, 622 aa, Burkholderia mallei
MCGITGWIDFARDLRNEAPIVDTMTDTLARRGPDARGVWLDTHAALGHRRLSIIDPERGAQPMLTPERGPRGLPRAVISYAGETYNFRELRAELGALGHRFDTHCDTEVVLRAYLEWGAAFVDRLNGMYSIAIWDTARDELLLVRDRLGVKPLFYYPTADGVIFGSEPKAILAHPDVRARTSSEGLCDALLFLRTPGQVPFSGMREVKPGHVLRVRRGGLAEQRYWALEARPHTDDLPTTIATIRALLDDIVSRQMISDVPLCALLSGGVDSSTIAALAQKRRRANGGGALSTFCVDFTGHTRNFRADPIRPTADAPFALEVARHIGSDHHTIELDQAGLLDPQVREAVLRAWDLPFNFADLDVSLHRLFAEVRKHATVALSGEAADEIFGGYLWFSDPAARRAHTFPWLKLGAHRGLDPRALFHRSFIDALRLGEYEAQLYRAALAEVPRLDGENAEDRRTRELHYLTLTRWLPVLLDKKDRMGMASGLEGRVPFCDHRLVEYVFNIPWAMKTFSGQEKALLRAAAADLLPESVLNRKKAAYPSIQAPGYDRGLIERLNRAIAAGRAPLEPFIDAGALRGLTEKTAAGSLSEFERILLESSSRLNDWLDLYRVELDGVPAG

SEQ ID NO: 28850 - protein, 518 aa, Oryza sativa
MVGAGEGDRVGGGAAVGGGQQFVDRSKVRILLCDSDPSSSREVLRLLCNCSYQVTCAKSPRQVINVLNCEAGEIDIILAEVDLPVSKCFKMLKYIARNKELRHIPIIMMSNRDEVSVVVKCLRLGAAEYLVKPLRMNELLNLWTHVWRRRRMLGLSEKNFFNDNFELALSEPSDANTNSTTLLSDDTDDKPKENINQETSTSNQHEYESNPSDAEPKQKGTPEGLLVSTEGGDQASSPGVMFSRPIKTNLRVAESSAFLAYVKSSTPTTSSFDSELQKGGNRLDSSDHRGNFSSTTDRSDTGTDVNIRDKEAFEMPVQYPVVCFSSSNLHLERSNEGQNDASGTPPVYHFPFYYPGMMDHGMTHPPVQNFQGNINNAQVHTPQTLLPQYNVYPQCHGVSMMPPFQYNPAGMSIQSNQLPTQNMWPQASSTPMPEETCSRSERRAAALAKFRLKRKERCFDKKVRYVNRKKLAETRPRVRGQFVRQANYTDITSTGDDISEDEDDDPSSREVEMVSSPE

SEQ ID NO: 28851 - protein, 595 aa, Oryza sativa
PRITLYSLVTAVFSDPISLVRDHRLKEMMAAEGIIVQSFNADLLYEPWEVVDDEGQSFTMFAPFWNRCLSMPYDPAAPLLPPKRINSGDLSMCPSDDLIFEDDSERGSNALLARAWSPGWQNADKALTAFLNGPLIHYSVNRKKADSASTSLLSPYLHFGELSVRKVFHLVRMKQLVWSNEGNRAAEESCTLFLRSIGLREYSRYLSFNHPCSHEKPLLAHLRFFPWVINECYFKIWRQGRTGYPLVDAGMRELWATGWLHDRIRVVVSSFFVKVLQLPWRWGMKYFWDTLLDADLESDALGWQYISGSLPDGRELDRIDNPQLEGYKFDPHGEYVRRWLPELARLPTEWIHHPWDAPASVLQAAGVELGSNYPLPIVGLDAANARLQEALSEMWQLEAASRAAMDNGMEEGLGDSSEVPPIEFPRELQMEVDREPARVTANVLTTARRREDQMVPTMTSSLNRAETEISADFMSSVDSRAEVPTRVNFEPRTEREENFRTTAGNVARTNGIHEHNNFQQPQHRMRNVLAPSVSEASSGWTGREGGVVPVWSPPAASDHSETFASDEADISSRSYLDRHPQSHRLMNWSQLSQSL

SEQ ID NO: 28852 - protein, 187 aa, Streptomyces coelicolor
MMRVDANDMGADLEKVLITKEEIDAKLAELAAKIDAEYAGKDLLIVGVLKGAVMVMADLARTLSTPVTMDWMAVSSYGAGTQSSGVVRILKDLDTDIKGRHVLIVEDIIDSGLTLSWLISNLGSREPASLKVCTLLRKPDAAKVAIDVEWVGFDIPNEFVVGYGLDYAEKYRNLPFVGTLAPHVYGG

SEQ ID NO: 28853 - protein, 304 aa, Rhodobacter sphaeroides
MLGFGDKPANGAAPQGDLVKDTSEATFMQDVIDASRDVPVIVDFWAPWCGPCKTLGPALEAAVTAAKGKVRMVKVNVDENQMIAAQLRIQSIPTVYAFFQGQPVDGFQGALPPSEVKKFVEKIAAMGGDDGLADALAAAEEMLAEGAVVDALETFAAILGEEPENAAAYAGLIRCHLASGDLDQAEAYAAAAPAAIAKAKEIEGARAQIELARQAAKAGPVTELSRAVEADPANHQARFDLALALHASGQIDEAVDQLLELFRRDREWNEGAARTQLFTIFDALKPTDPIVLKGRRRLSSMIFA

SEQ ID NO: 28854 - protein, 447 aa, Methanosarcina acetivorans [sequence omitted]

SEQ ID NO: 28855 - protein, 385 aa, Methanosarcina acetivorans
MTDREQFFRDVNKIVIKIGTSSITRKGCDHTKENCNIDPAFMESIAAQVYELRKHGKEVILVSSGAIGVGLNELGIAPKPREIPIRQAAAAVGQSILMQDWSRAFSKYGMKVAQILLTYEFYSDRVTYLNLRNSISTLLEYEVVPIINENDCTCTNEIEAIFGDNDKLSAMVASKIDADLLIILSDIDGLFDRNPKTHSDAKLLTLIKKITPEIESYGGDPTNFKGVGGMRTKIKAAKICSMAGCYVVIANSEIEDVVTKILSGEEIGTLFLAERHIQKNRARWIILARASGTVRVDAGAKAAVLGKNSLLPAGIVDIEGTFDRGDVVKLECEGKVFAKGITNYTSKELIKIKGAQTNQIDNILGYNNYDNVIKKENIGILEGIN

SEQ ID NO: 28856 - protein, 262 aa, Betula pendula
IAAGVQFGWALQLSPLTPYVQLLGIPHTWAPFIWLCGPISGLFVQPVVGYYSDRCTSRFGRRRPFIAAGSSLVAIAVFLIGYAADLGHVFGDPIDKTTKTRAIAVFVLGFWILDVANNMLQGPCRALLADLSGDDQRRMRTGNALYSFFMAVGNVLGFAAGSYTRLYKLFPFTSTEACDVYCANLKSCFFLSIALLLILTTIALTAVKEQILSPQPEPGTAGGEEKQVVPFFGEIFFALKGLQRPMRILLMVTCLNWIAWFP

SEQ ID NO: 28857 - protein, 1237 aa, Xanthomonas oryzae
MRNATMKRMLINATQAEELRVAIVDGQTLYDIDIEQPSKEQKKSNIYKGRITRLEPSLEAAFVDYGAERHGFLPLKEISRDYFQAGVDHNKSTIRELLREGQEIVVQVDKEERGNKGAALTTFISLAGRYMVLMPNSPSAGGVSRRIEGEDRAALKEALDKLDIPDDMGVIIRTAGVGRDAEELQWDLDYLLQTWKAIAEAALSKPAAFLIYQESRLIIRALRDYLRADVGEILVDTPELYADAQEFMKQVMPQSLRKLKHYTDDIPLFNRFQIESQIEGAYERNVRLPSGGSIVVDQTEALTAVDVNSSRATKGSDIEETAFQTNLEAAEEVARQLRLRDLGGLVVIDFIDMASSKHQREVENKLQNALKYDRARVQLGRISRFGLMEMSRQRLRPSLGESSQIVCPRCDGHGRMRSVESLSLSIIRVAEEHAMKENTGQVLVQAPVEIANYLLNEKRSALREIEQRHESPIIIVADEQLHTPHYEVTRLRENELGEDSGKPSYQRGTPRKLPVHALTKAQLNIPAPPAVTSIKPSQPAPVREETPAPVAPVAAPAPVVTVPIPAPVTGVVGWLKRIFGGVEPLAPAPESIPRPRQNDAGRNHRNERGERGGQRRDGRDARNGGHSGNQQRGNGNGANKERRDERRQPASGQGAQNGAQAQQQAQTPKPPRNEAQSPKQQQPQQAQQQKPKPQNQTPRPPRTPAQQDGAQAERQPRPARQDEGMAAAQTVTSTAAMATTSSVVAAITDAAAPATAQTNANEAAQAHAVDVTVSASTADPGADASVAAPAQDAAGDDAANGEGGSRRRRGRRGGRRRRRGVGANGGEGGASVDGLEGDDLDGDADNDLDSDSEGDAAAAQAHASAAPRAGQPEFDFDDDAPAPTVRAKPEPTAQAAAKPRPVPKERAEPQVGNDTSLTTAPVSNTVPASQPPVATPVAKADTNHERPAAPTVAADAPAKPAPAATASTAVNADVAATQAVKQRPAPVAQHAPAAPAPVAAPAPVASTPVPAGAAVAPVAETASTAPVATPSAPASTVASPVSNVAATSTQHQPLGSASARAAASDTDKAAAPNADRQQRAAAADVATPATTQAAPVQTTPVKQTADLSAPVAAMPAAQAEVVTATSPHAEPPAAQAPSSEVAVTATSTLVQASPTADATPVRKRYAPVQTTMLDTLSPNDAATSAPAASEHPCARCSTARSNGSGIGIGSGRQAQADGGGIRSQACCPIDGGRQGAG

SEQ ID NO: 28858 - protein, 504 aa, Unknown
  Synechococcus sp. CC9311
MRLGSPVTVAPTSARFNRSEWSSAFRNVEEELTDVPLKPVRGAVPDALRGTLYRNGPGRLERDGQRVHHPFDGDGMITALHFDADGVRCSNRFVRTSGWKAEEAAGKVLFRGVFGSQKPGGPLANAFDLRLKNIANTSVVRLGDDLLALWEAAEPYALDPQTLETRGLSLLGGVLKRGEAFSAHPRFDPGHHGDPRMVTFGVKTGPRSTIRLMEFATEDNAAAGIRAGDLLSDRRDTFAGFAFLHDFAITPNWAVFLQNAINFNPLPFVLGQKGAAQCLTSNPNGKAKFWLIPRDSGTFAGQEPRVIDAPDGFVFHHLNAWEEDGDVVVESIYYSDFPSIGPDQDFADVNFDLIPEGLLEQCRINLISEKVDTTRLSERCCEFAMVNPNQEGLPCRFAWMAAAARERGNDPLQVVKKLDLQTGEKLIWSAAPSGFVSEPIMIPRPNASDEDDGWVLDLVWNGARDASDLYILDARDLSEVALLELPLAIPHGLHGSWSESSLQP

SEQ ID NO: 28859 - protein, 242 aa, Unknown
  Vibrio sp. Ex25
MATVSMRDMLKAGVHFGHQTRYWNPKMKPFIFGARNKVHIINLEKTVPMFNDALAELAKVGEKKGKVLFVGTKRAASEAVKEAAIASNQFYVNNRWLGGMLTNYKTVRQSIKRLKDLETQSQDGTFDKLTKKEALMRTREMEKLEKSLGGIKDMGGLPDALFVIDADHEHIAIKEANNLGIPVYAVVDTNSNPDGVDYVIPGNDDAIRAVQLYLNAAASAVSEGRNKDVAAVAEKDGFVEAE

SEQ ID NO: 28860 - protein, 632 aa, Bacillus licheniformis
MCGFVGVFNHRPSSETAAQEELIKQMNEMIVHRGPDDDGYYHDEHVGFGFRRLSIIDVENGGQPLSYEDDSYWIIFNGEIYNYIELKDELLSKGYEFKTDSDTEVLLATYRHYKQEAASKLRGMFAFLIWDKKEQLLYGARDPFGIKPLYFTKTDGHVYFASERKSLMAVDADLELNEKALQQYTSFQFVPEPETLDKKVQKVESGHQFTVRPGEDIQFKTYWKVQFKPVQTEEDKLVQEVRDAIFDSVKVHMRSDVPVGSFLSGGIDSSFIVSVAKQFHPNLKTFSVGFEHEGFSEVDVAKETADKVGVENFSAIISPEEYMNELPKIVWHLDDPLADPAAIPLYFVAKEAKKQVTVVLSGEGADELFGGYNIYREPLSLKPFERIPSPLKKMLLRVASAMPEGMKGKSFLMRGCTPLEDRYIGNAKIFEEGMKSKLLRQYDSNLSYCDVTKPYFEESRSYSEINKMQYVDIHTWLRGDILLKADKMTMANSLELRVPFLDKVVFEAASKIPEELKTKNGTTKYLLRKAAEGIVPEHVLNRKKLGFPVPIRHWLKNEMHDWAVNIIKESETDAYIHKDYVLQLLEDHCANKADNSRKIWTVLIFMIWHSIFVEKRFVPEELNHQPKEVIIV

SEQ ID NO: 28861 - protein, 112 aa, Thiobacillus denitrificans
MKFVTAIIKPFKLDEVREALSAIGVTGLTVTEVKGFGRQKGHTELYRGAEYVVDFLPKVKLEVAIKADLLERVIEAIEHAANTGKIGDGKIFVSSLEQVVRIRTGESGPDAL

SEQ ID NO: 28862 - protein, 424 aa, Prochlorococcus marinus
MTDRCLASINAALTDSDPAIAGLIDQERQRQETHLELIASENFTSQAVMQAQGSVLTNKYAEGLPHKRYYGGCEHVDAIEELAIERARRLFGAAWANVQPHSGAQANFAVFLALLQPGDTIMGMDLSHGGHLTHGSPVNVSGKWFKVVHYGVEPDSQQLDMEAVRQLALKERPQLIICGYSAYPRTIDFAAFRSIADEVGAYLLADMAHIAGLVAAGVHPSPIAHCDVVTTTTHKTLRGPRGGLILCRDADFGRKFDKAVFPGSQGGPLEHVIAAKAVALGEALQPEFHAYSCQVVANAQVLAGRIQERGIAVVSGGTDNHLVLLDLRSIGMTGKVADLLVSDVNITANKNTVPFDPESPFVTSGLRLGTAALTTRGFDEEAFREVADVIADRLLKPQDESIKAQCLERVRQLCGRFPLYRGSL

SEQ ID NO: 28863 - protein, 576 aa, Thermotoga maritima
MKRLRVTLAQLNPTLGDFEGNLKKAIEALRVAEDRGSDLLVFPELFLPGYPPEDLMLRLSFLRENRKYLQKFAQHTRNLGVTVLMGFIDSDEDAYNAAAVVKDGEILGVYRKISLPNYGVFDERRYFKPGEELLVVKIGNIKVGVTICEDIWNPVEPSASLSLGEGVHLIANLSASPYHVGKPVLRKDYLSMKAYDYHVAMAYCNMVGGQDELVFDGGSMVVDASGEVINYGKLFEEEIITVDLDLDENLRVSLVDPRRRYMKTQNYPVKTVEAGNLREKSGHFEPVVNPLPVREEEMFRALITGLRDYVRKNGFEKVVIGLSGGMDSSLVAVIATEALGKENVKGVLMPSMYTSKESIEDAQTLAKNLGIETFIIPITDVFHSYLETLKGVFAGREPDITEENLQARIRGNYLMALSNKFGWLVLTTGNKSEMATGYATLYGDMAGGFAVIKDVYKTDVYRIGRWYNSWRGKEIIPENIFVKPPTAELRPGQTDQEKLPPYEVLDEILRLYIEEGLDPEEIASKGFDRKTVLDVTEMIRKNEYKRKQAAIGVKISTRAFGKDWRMPITNRFKEPL

SEQ ID NO: 28864 - protein, 341 aa, Bordetella parapertussis
MLHLAKFPRIKLGHFPTPLEFMPNLTRHLGGPNLYIKRDDCTGLATGGNKTRKLEFLVAQAVAQGADTLITQGAVQSNHARQTAAAAARVGMKCKILLEERVPHPDDDYSHSGNVMLDGLMDGEIVARLPAGTDMQQAMEDLARELAGRGSKPYVIAGGGSTPVGALGYVACAQELLHQSFETGLRIDHVVHATGSAGTQAGLVVGLRAGNSGIPVYGISVRAPKPRQEENVWKLVQSTVDYMGLPASAVERADVVANSDYVGEGYGISTDAMIEAVHMTAALEAILLDPVYSGKGMAGLIGLIRSGHFKQGENVVFVHTGGAVGLFGYRRAFEGLPPLAA

SEQ ID NO: 28865 - protein, 406 aa, Xanthobacter autotrophicus
MVTRRQALRSVGGMVLGYGASLVAGSRVAAAAAETITLPFANGERPLVTYPGKRALIGLTSRPPQLETPFSVFNEGILTPNDAFFVRYHLADIPLEIDPAAFRLEVKGKVSTPLSLSLDELKTKFDPVEYVAVHQCSGNSRGFFDPRVGGGQAGNGLMGNARWKGVPLKAVLEKAGIASGAVEVYFTGLDNPVIPETPRFAKSLKLDHALDGEVMLAYQMNGEDLPWLNGFPLRLVVPGYFGTYWVKHLNQIAVLDKPLDNFWMSTAYRIPDNDCACVPAGGKPEKTVPIGRFAVRSFLTNVLDGAKVAAGKPLALRGIAFDGGSGIARVEVSADGGKTFMPAALGADLGKYSFREWTANMTLPAGPHALKVRATNALGQTQPMEARWNPSGYMRSVVETTNVVAG

SEQ ID NO: 28866 - protein, 451 aa, Magnaporthe grisea
MGQTLSEPVVEKASARGEDDRFLYGVSAMQGWRISMEDAHTTVLDLLANDAEAAKQHKGKLAFFGVFDGHGGDKVALFSGDNIHKIVQNQDTFKSGNYEQALKDGFLATDRAILNDPKYEDEVSGCTACVGLLTDDKIYIANAGDSRSVLGVKGRAKPLSFDHKPQNEGEKARITAAGGFVDFGRVNGNLALSRAIGDFEFKKSAELAPEQQIVTAYPDVVVHDMGDDDEFLVIACDGIWDCQSSQAVVEFVRRGIAAKQALEKICENMMDNCLASNSETGGVGCDNMTMIIIGFLRGRTKEEWYEEIARRVANGDGPCAPPEYAEFRGPGVHHNFDDSDSGYDVDMDQSKGKTFGIGGYKGRVIFLGDGTEVLTDADDNAMFESEKQDLDSQVAKTGSSEDDGTTEDQTNKKEGTTDGKADKGTKDASEEAEAKAENIDAAVKKDEDIKV

SEQ ID NO: 28867 - protein, 978 aa, Bacillus cereus
MAEQTVRVTVDGKEFSASGEKTILQLFNESNLEHPQICHVPEVDPIQTCDTCIVEVDGKLMRACSTQIENGMHIERQSQRAKEAQTEAMDRILENHLLYCTVCDNNNGNCKVHNTVHMMGIEEQKYPYEPKVSACEVDMSHPFYRYDPNQCIACGQCVEVCQNLQVNETISIDWSLDRPRVIWDHGVSINDSSCVSCGQCVTVCPCNALMEKSMLGEAGFMTGLKPDVLDPMIDFVKDVEPGYSSILAVSEVEAAMRKTKVNKTKTVCTFCGVGCSFEVWTKDRHILKVQPVSDAPVNGISTCVKGKFGWDFVNSEDRITKPLIRQGDMFVEATWEEALEVVASNMQHIKSEYGSDAFGFISSSKVTNEENYLMQKLARQIYGTNNVDNCSRYCQSPATDGLFKTVGMGGDAGTVKDIAEAGLVIIVGANPTEGHPVLATRVKRAHKLHEQKLIVADLRKHEMAERADLFIHPRQGTDYVWLAGITKYIIDQDWHDKKFIAENVKNFDEYSTMLEKYTLDYTEEITGISKENLKEMARMVYEADGTCVLWGMGVTQNTGGSTTSAAISNLLLVTGNYRRPGAGAYPLRGHNNVQGACDMATLPNWLPGYQAVSDDTLRAKFEKAYGTTIPKAPGLNNIAMLLAADEGKLRGMYVMGEEMALVDSNANHVQHILANLDFLVVQDMFLSKTARFADVILPAAPSLEKEGTFTNTERRIQRLYEVLKPLGDSKPDWWILQKVARALGGDWNYESPSEIMDEIASLAPLYSQATYDRLEGWNSLCWGSHDGSDTPLLYVDGFNFPDKLARLSLDEWVPPVVAPDEYDLLLNNGRMLEHFHEGNMTNKSAGILSKVSEVFVEISPELAIERNVKDGGLVELASPFGKIKVQALITDRVTGKELYLPMHATINEEAINILTGTATDLYTCTPAYKQTMVKMRVLREKGNRPLPSSNPRDKKRNPQNGVEIEQKWQRKQYVSLVD

SEQ ID NO: 28868 - protein, 181 aa, Triticum aestivum
  misc_feature (43)..(43): Xaa can be any naturally occurring amino acid
  misc_feature (68)..(68): Xaa can be any naturally occurring amino acid
  misc_feature (90)..(90): Xaa can be any naturally occurring amino acid
  misc_feature (157)..(157): Xaa can be any naturally occurring amino acid
  misc_feature (170)..(170): Xaa can be any naturally occurring amino acid
KFSVIRAIDDAAVLVALPVSTLKIRVLSNLTAEKKISVPVLDXAAFSEPEYDLHIQFATAYTTPAQSXIVVLDLNSLCDIPEVKAYKDKXYRNLMPFMPKYSEVLGSYPSLQIYYPSLFILALYIERYLYLEKMQLLSWGGKISRESVRFFSPIVIXLYVKPAERSHHAXLSSAQMEYYKV

SEQ ID NO: 28869 - protein, 442 aa, Shigella boydii
MSKQQIGVVGMAVMGRNLALNIESRGYTVSIFNRSREKTEEVIAENPGKKLVPYYTVKEFVESLETPRRILLMVKAGAGTDAAIDSLKPYLDKGDIIIDGGNTFFQDTIRRNRELSAEGFNFIGTGVSGGEEGALKGPSIMPGGQKEAYELVAPILTKIAAVAEDGEPCVTYIGADGAGHYVKMVHNGIEYGDMQLIAEAYSLLKGGLNLSNEELAQTFTEWNNGELSSYLIDITKDIFTKKDEDGNYLVDVILDEAANKGTGKWTSQSALDLGEPLSLITESVFARYISSLKDQRVAASKVLSGPQAQPAGDKAEFIEKVRRALYLGKIVSYAQGFSQLRAASEEYNWDLNYGEIAKIFRAGCIIRAQFLQKITDAYAENPQIANLLLAPYFKQIADDYQQALRDVVAYAVQNGIPVPTFAAAVAYYDSYRAAVLPANLIQ

SEQ ID NO: 28870 - protein, 189 aa, Cucumis sativus
MASSILSSAAVASVNSASPAQASMVAPFTGLKSSAGFPITRKNNVDITTLASNAGKVQCMKVWPPLGLRKFETLSYLPDMSNEQLSKECDYLLRNGWVPCVEFDIGSGFVYRENHRSPGFYDGRYWTMWKLPMFGCTDSSQVIQEIEEAKKEYPDAFIRVIGFDNVRQVQCISFIAYKPQVLLFLSSIC

SEQ ID NO: 28871 - protein, 246 aa, Agrobacterium tumefaciens
MSKAPTSTNRTGRKIGQKVKKTKLKASSRRWLERHINDPYVQRAKLEGYRARAAFKLLEINDKHQILKGATRIIDLGAAPGSWSQIASKVTDSTEDDIRVAAIDFLEIDPIPGVKILQLDFLDPTAPDQLMEAVGGTPDLVLSDMAAPTTGHQKTDHIRTMHLCEVAADFAVQVLAEGGHFLAKTFQGGTEKALLDMLKKNFKQVLHIKPASSRSESVEMFLLAKHFKGRRHEPAIDADAEESTED

SEQ ID NO: 28872 - protein, 421 aa, Streptomyces avermitilis
MVDADQTFVIVGGGLAGAKAAETLRAEGFTGRVILICDERDHPYERPPLSKGYLLGKEERDSVFVHEPAWYARNDIELHLGQTVDAVDRAAKTVRFGDDGTLVHYDKLLLATGAEPRRLDIPGTDLAGVHHLRRLAHAERLKGVLAALGRDNGHLVIAGAGWIGLEVAAAAREYGAEVTVVEHGPTPLHGVLGPELGQVFAELHREHGVRFHFGVRLTEIVGQDGMVLAARTDDGEEHPAHDVLAAIGAAPRTGLAEAAGLTLADRAHGGGIAVDGRLRTSDPDIYAAGDVAAFHHPLFDTRLRVEHWANALNGGPAAARAMLGRDLTYDRMPYFFSDQYDLGMEYSGWAPPGTYDQVVIRGDAGKRQFIAFWVKEGRVLAGMNVNVWDVTEPIQALIRSGTPVDTEALANPHVPLETLTP

SEQ ID NO: 28873 - protein, 137 aa, Bacillus subtilis
MKIALIAHDKKKQDMVQFTTAYRDILKNHDLYATGTTGLKIHEATGLQIERFQSGPLGGDQQIGALIAANALDLVIFLRDPLTAQPHEPDVSALIRLCDVYSIPLATNMGTAEILVRTLDEGVFEFRDLLRGEEPNV

SEQ ID NO: 28874 - protein, 425 aa, Unknown
  Sphingomonas sp. tfd44
MLSHADNMKMCQTGRGTPMGEALRRFWIPVLLSEQLSEPDGPPRRLEIMGETFAAFRNTDGVVGILDEQCCHRGASLVLGRVEGCGIRCLFHGWKFAVDGTIMETPNVLDPRFKEKFRAKSYPVREEGGMIWMYMGPAELEPPFPHWPYFDVPAENRLAVAFVVDECNFVQLGEALVDSSHLTILHKDIFARDSDTVVAVAVKNAGAVAAPKIEVQETDFGLYYAATRAVPTEDGGTVDEVRLATFVAPFHYHNANGNFLGIIVPMTDTRTLHYFVWWDEEKQLGLEPTRSAILRDGNLTEELLIQMGTHPDTWFLPDKPNRMNNYRQYREAMKNGAWTGIPPLVPEDVVILSSSGAIRDRSKEILAPADIGVARLYRVFLRLADAIANGEEPSALYSNPMTIAGTHFLVPEARLGRILFQSMSR

SEQ ID NO: 28875 - protein, 70 aa, Glycine max
AAHTHTYKIEKILFHGKSQYRELLVFETSRQGKGAILDGHIQLTEKDEFAYKETRTHLALWSHTKKKKVL

SEQ ID NO: 28876 - protein, 321 aa, Synechococcus elongatus
MSETQQPTVIITGASSGVGLYGAKALAARGWHVVMACRNLQKAAEAAKSLGINPENYSLMEIDLGSLASVRRFVDQFRATGRSLDALVCNAAVYLPRLKEPQRSPEGYEISVATNHFGHFLLCNLLLDDLKRSPAPEKRLVILGTVTANSKELGGKIPIPAPADLGNLEGLEAGFKAPIAMIDGKKFKPGKAYKDSKLCNMITTRELHRRFHDSTGIVFGSLYPGCVADTPLFRNTPKLFQKIFPWFQKNITGGYFTQELAGERVAQVVADPEFKTSGVHWSWGNRQQKDRQSFVQELSDKASDDRTAQRLWDLSAKLVGL

SEQ ID NO: 28877 - protein, 173 aa, Prunus avium
MASQSGSGSKSIHDFTVKDAKGKDVDLSIYKGKVLLIVNVASQCGLTNSNYTELSQLYEKYKNQGLEILAFPCNQFGAQEPGSNDEIVEFACTRFKAEYPIFDKVDVNGDNAAPIYKFLKSSKGGLFGDSIKWNFSKFLVDKKGMLLTVCPTLLSYIRRVRTVGLQAPSVIRN

SEQ ID NO: 28878 - protein, 557 aa, Yersinia pseudotuberculosis
MIESFAQLFEESLKTIETRPGSIVRGVVVSIDKDIVLVDAGLKSESAIPAEQFKNAQGELEIQVGDEVDVALDAVEDGFGETLLSREKAKRHEAWLMLEKAYEEAATVTGVINGKVKGGFTVELNGIRAFLPGSLVDVRPVRDTLHLEGKELEFKVIKLDQKRNNVVVSRRAVIESENSAERDQLLENLQEGMEVKGIVKNLTDYGAFVDLGGVDGLLHITDMAWKRVKHPSEIVNVGDEITVKVLKFDRERTRVSLGLKQLGEDPWVAIAKRYPESTKLTGRVTNLTDYGCFVEIEEGVEGLVHVSEMDWTNKNIHPSKVVNVGDVVEVMVLDIDEERRRISLGLKQCKSNPWQLFAETHNKNDRVEGKIKSITDFGIFIGLDGGIDGLVHLSDISWNVAGEEAVREYKKGDEIAAVVLQVDAERERISLGVKQLAEDPFNNYLSVNKKGAIVTGKVTAVDAKGATVELAGGVEGYLRASEATRDRVEDATLVLNVGDEVEAKYTGVDRKNRVISLSVRAKDEADEKDAIATVNTKPEESNFSSAMAEAFKAAKGE

SEQ ID NO: 28879 - protein, 420 aa, Unknown
  Shewanella sp. ANA-3
MSNVRYISNLTRETYALILAGGRGSRLHELTDWRAKPALYFGGKFRIIDFPLSNCINSGIRRVGVVTQYKSHSLIRHVMRGWGHFKKELGESVEILPASQRYSENWYQGTADAVFQNIDIIRHELPKYVMVLSGDHVYRMDYAGLLAAHAESGADMTVSCLEVPVAEAAGAFGVMEVDDEMRILGFEEKPKHPKHSPGNPEKCLASMGNYVFNTEFLFEQLKKDAQNANSDRDFGKDIIPSIIEKHKVFAYPFKSAFPNEQAYWRDVGTLDSFWQANMELLSPTPALNLYDAKWPIWTYQEQLPPAKFVFDDDDRRGMAVDSIISGGCIISGATVRRSVLFNEVRVCSYSVVEDSVVLPDVVVLRHCKIKNAIIDRGCIIPEGTVIGYNHDHDRAKGFRVSEKGITLVTRDMLGLPVGYE

SEQ ID NO: 28880 - protein, 752 aa, Unknown
  Shewanella sp. ANA-3
MTNPVPVNADGSTAYNLSAGQPFPLGATVDDGGVNFALFSAHATGVELCLFNARGEVEIQRIALTEQTQQIWHLYVHGLSAGQLYGYRVYGPYEPQLGHRFNPHKLLLDPYARQLVGRYHHHIANFGYEIDNPNEDLSFSTLDNADFVPKCKVVDTRPLLDAAKAHTIRPLASKREPLPLEQCIIYEMHLKGFTALHPEIDAPLRGTFAGLASNAAIDYLVNLGVNCVELLPVQAFFSEPFLLEKQLSNYWGYNSIGFFAPEPSYLSGEDIGEFRNMVDALHGAGIEVILDVVYNHSAEGSRLGPTFSFRGIDNLSYYRLHPNDKRFYINDTGCGNTLNLNHPRMLQLVLDSLRYWVEVMGVDGFRFDLAACLGREAYGFDPGSGFFDALLQDPVLCRVKLIAEPWDIGPGGYQLGNFPVAFSEWNDRYRDTMRRFWRGDHAMLPEFARRFHGSGDFFEHSGRPPAASINFLTSHDGFTLKDLVSYCERHNWANGEENRDGHHENFSHHYGVEGDTDDATILALRARQQRNLLTTLFLSQGVPMLLSGDETGRTQGGNNNAYCQDNPLNWFDWSSDGMDSSLLSFTSQLIALRKRFPLLCAKRFIHEQLVANAFDWSSESSSTQAASPVSTPSGARLDWFSRQGEPMSKSLWSESMGRSLCVVLSGNLTATQPQTQGDSLQALLLMVNADEHPLAFTLPIFDGLGPWQCLLHTQTDPQFLTPTEPLDAQSSPTRYLLQDRSLMLFHADFIRN

SEQ ID NO: 28881 - protein, 304 aa, Ensifer adhaerens
MTRQMILAVGQQGPIARAETREQVVVRLLYMLTKAASRGANFIVFPELAFTTFFPRWHFTDEAELDSFYETEMPGPVVRPLFEKAAELGIGFNLGYAELVVEGGVKRRFNTSILVDKPGKIVGKYRKIHLPGHKEYEAYRPFQHLEKRYFEPGDLGFPVYDVDAAKMGMFICNDRRWPEAWRVMGLRGAEIICGGYNTPTHNPPVPQHDHLTSFHHLLSMQAGSYQNGAWSAAAGKVGMEENCMLLGHSCIVAPTGEIVALTTTLEDEVITAAVCLDRCRELREHIFNFKQHRQPQHYGLIAEL

SEQ ID NO: 28882 - protein, 640 aa, Oryza sativa
MGGGLVMDQGMMFPGVHNFVDLLQQNGGDKNLGFGALVPQTSSGEQCVMGEGDLVDPPPESFPDAGEDDSDDDVEDIEELERRMWRDRMKLKRLKELQLSRGKDPAGGVVGDPSKPRQSQEQARRKKMSRAQDGILKYMLKMMEVCRAQGFVYGIIPEKGKPVSGASDNLRGWWKEKVRFDRNGPAAIAKYQADNAVPGCESELASGTGSPHSLQELQDTTLGSLLSALMQHCDPPQRRYPLEKGVPPPWWPTGDEEWWPELGIPKDQGPPPYKKPHDLKKAWKVSVLTAVIKHMSPDIEKIRRLVRQSKCLQDKMTAKEISTWLAVVKQEEELYLKLNPGARPPAPTGGITSAISFNASSSEYDVDVVDDCKGDEAGNQKAVVVADPTAFNLGAAMLNDKFLMPASMKEEATDVEFIQKRSASGAEPELMLNNRVYTCNNVQCPHSDYGYGFLDRNARNSHQYTCKYNDPLQQSTENKPSPPAIFPATYNTPNQALNNLDFGLPMDGQRSITELMNMYDNNFVANKNLSNDNATIMERPNAVNPRIQIEEGFFGQGSGVGGSNGGVFEDVNGMMQQPQQTTPAQQQFFIRDDTPFGNQMGDINGASEFRFGSGFNMSGAVEYPGAMQGQQKNDGSNWYY

SEQ ID NO: 28883 - protein, 590 aa, Unknown
  Frankia sp. EAN1pec
MLRPQDGSTRERRSLGGLWAFRLDPAGTGRNAGWWRARLPGAREMPVPASYNDIVPDLAVRDHVGDAWYQTVVRIPAGWSARRVVLRFDAATHRAVVWVNDTLVAEHEGGYTPFEADITGVVAPGDEARVTVVVNNELTLTSIPPGIVEDTAQGRRQKYFHDFFNYAGLHRSVWLYTTPHTRISDIAVETALDGAAGTVRYAVEIEGAQGVAAIRVVLRDAQGREVAAADGAVGMLNVPAVHPWAPGDGYLYELDARLVGAGGEVADSYVLPVGVRTVEVRGTQFLINGEPFYFRGFGKHEDAPVRGKAHDDALMVHDFELMEWIGANSFRTSHYPYAEEVLEYADRSGIVVIDETAAVGLNLKASLAFGSRPTVSTFGEDGISSVTQRAHLQAVRELIIRDRNHPSVVLWSLANEPDSSTAAAREYFAPLFAEARKLDPTCPVGFVNSFDQCQVTELADVVMINRYYGWYINNGELKAAEVALEAELNRWAAHGKPVIVTEYGADTMAGLHAVVDTPWSEEYQVRFLEMHHRVFDRVDAVIGEHIWNFADFATSPHIIRVDGNKKGVFTRDRHPKSAAFSVRRRWRPQA

SEQ ID NO: 28884 - protein, 394 aa, Triticum aestivum
AASLPGAPALIEKPPTRPESAARAPPRLPPRAPQSAGGAPPRSPPRHTPEPGSRAAVRRRAEAGVRARAMDVDSVECLSLPDAAMDADDVGLALHPHGGILAAASRPAAYPKAGAGAGGIVAPGSSVHELLECPVCTNSMYPPIHQCQNGHTLCSTCKARVHNRCPTCRQELGDIRCLALEKVAESLELPCKHYSLGCPEIFPYYSKIKHEAMCSFRPYSCPYAGSECSVTGDIPYLVNHLRDDHKVDMHSGCTFNHRYVKSNPREVENATWMLTVFHCFGQYFCLHFEAFQLGMAPVYMAFLRFMGDENEARNYSYSLEVGANGRKMVWEGTPRSVRDSHRKVRDSHDGLLIQRNMALFFSGGDRKELKLRITGRIWKETQTPDGACVPVLCS

SEQ ID NO: 28885 - protein, 173 aa, Flaveria trinervia
MASIPATVAAVPQTNMVAPFTGLKANAAFPVTKKVNGFSTLPSNGGRVQCMKVWPPVGKKKYETLSYLPELTEAQLAKEVDYLLRNKWVPCLEFELEHGFVYRENASSPGYYDGRYWTMWKLPMFGCTDSAQVMKELQECKKEYPQAWIRIIGFDNVRQVQCVSFIASKPTGF

SEQ ID NO: 28886 - protein, 178 aa, Helianthus annuus
MASISSSVATVSRTAPAQANMVAPFTGLKSNAAFPTTKKANDFSTLPSNGGRVQCMKVWPPLGLKKYETLSYLPPLTETQLAKEVDYLLRKKWVPCLEFELEHGFVYRENARSPGYYDGRYWTMWKLPMFGCTDSAQVMKELAECKKEYPQAWIRIIGFDNVRQVQCIMFIASRPDGY

SEQ ID NO: 28887 - protein, 144 aa, Xanthobacter autotrophicus
MSDTVEAVPMFERLGGAVVIDRLVEAFYRRMDTLAEAEGIRAMHADDLSQTKHVLKRYLTEWTGGPKLYSVEKGHPRLRQRHMGFAIGNGERDAWLLCMRGALEETVADAAARDEVYGAMAKLADWMRNTAGNPHDTAGHAARP

SEQ ID NO: 28888 - protein, 143 aa, Cucumis melo
PDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKA

SEQ ID NO: 28889 - protein, 170 aa, Cucumis melo
FLLPSPTAAASPPELAQPRPGFGSFDMNVVMVLSVLLCALICSLGLNAILKCALRCSTLLATVSGGRGGGALVVHPKGVRRNVLKKFPTVEYSKEGNKLRGIDGECVICLLEFEAGDRVRVLPKCYHGFHVHCIDKWLSSHTSCPKCRNCLTDTCHKIAAGCGQETPVTT

SEQ ID NO: 28890 - protein, 439 aa, Shigella boydii
MSKQQIGVVGMAVMGRNLALNIESRGYTVSIFNRSREKTEEVIAENPGKKLVPYYTVKEFVESLETPRRILLMVKAGAGTDAAIDSLKPYLDKGDIIIDGGNTFFQDTIRRNRELSAEGFNFIGTGVSGGEEGALKGPSIMPGGQKEAYELVAPILTKIAAVAEDGEPCVTYIGADGAGHYVKMVHNGIEYGDMQLIAEAYSLLKGGLNLSNEELAQTFTEWNNGELSSYLIDITKDIFTKKDEDGNYLVDVILDEAANKGTGKWTSQSALDLGEPLSLITESVFARYISSLKEQRVAASKVLSGPQAQPVGDKAEFIEKVRRALYLGKIVSYAQGFSQLRAASEEYNWDLNYGEIAKIFRAGCIIRAQFLQKITDAYAENPQIANLLLAPYFKQIADDYQQALRDVVAYAVQNGIPVPTFSAAVAYYDSYRAAVLPAN

SEQ ID NO: 28891 - protein, 172 aa, Cucumis melo
MDTKIGSLDTCKPQNNVVCCPSNGSVCTIQNSVVPSTVVNSSDATLGRHLARRLVQIGVTDVFTVPGDFNLTLLDHLIAEPALNNIGCCNELNAGYAADGYARSRGVGACVVTFTVGGLSVLNAIAGAYSENLPLICIVGGPNSTIMELTESFIYNGLPDLSQNSKVLKRYL

SEQ ID NO: 28892 - protein, 263 aa, Unknown
  Sphingomonas sp. tfd44
MKDEVFVVVGGGQAGGWIIKTLGVEGFSGRIVLIGDERHPPYERPPLSKNALRDAEAVSETALLSIENLAEAKVESWLGEEVVKIDRSAQTVRCASGRENRYDRLFLATGSRPRVPDWMAGQKSDRIHLLRTIDDAAALRSSLSGTKHLLIVGGGWIGLEVAATVRSLGIAVTVVEAAPRLCQRSVPEPVSDWLRSLHEGHGVAFVMGRSVDQLVEQPDGIMLELDDGTARMADRVLVCVGAIPNVALAELAGLDVSNGILVD

SEQ ID NO: 28893 - protein, 244 aa, Desulfitobacterium hafniense
MAVISMKQLLEAGVHFGHQTRRWNPKMARYIFTERNGIYIIDLQKTVRKVEEAYNYVRNLAADGGTVLFVGTKKQAQESVKEEAERCGMYYVNERWLGGMMTNFQTIQKRVSRLRELEKMEAEGVFEVLPKKEVAALRHEMEKLERFLGGIKSMKKLPDALFVVDPRKERIAVAEARRLNIPIVGIVDTNCDPDEIDVVIPANDDAIRAVKLLTGRIADAIIEGQQGSDEAEEAEEAAEEVVAE

SEQ ID NO: 28894 - protein, 590 aa, Geobacillus stearothermophilus
MFKEAIYHRPKDNFAYAYDEQTLHIRLRTKKNDVEHVRLIYGDPYEWENGHWQVSYQSMQKSGTDELFDYWFIALTPPYRRLRYGFELTSNNEQIVYTEKGFYRTAPMDDTAYYFCFPFLNKIDVFQAPEWVKDTIWYQIFPERFANGNEALNPAGTLPWGSADPTPTSFFGGDFEGIIQKLDHLVDLGVNGIYFTPIFKASSNHKYDTIDYFEIDPQFGDKQTFKRLVELCHQKAIRVMLDAVFNHSGYEFPPFQDVLKYGENSKYKHWFHIREFPLQTVPRPNYDTFAFTPNMPKLNTENQEVKNYLLDVATYWIREFDIDGWRLDVANEVDHQFWREFRQAVKTIKPDAYILGEIWHDAMPWLRGDQFDAVMNYPFTNGTLRFFAQHEIRASQFVGMMTHVLHSYPTNVNEVAFNLLGSHDTPRLLTLCKEDVRKAKLSFLFQLSFTGTPCIYYGDEIGITGDQDPGCRKCMIWDEHQQNRELFRHVQKLIALRKAYKAFGNRGNLHFIDANDETNHLIYMKTFEEEAIIFLVNNNEQEIEITLPLSLKGKLLTNLWTNEQFSAEADTLKSTLPPYGFFIYKIEDWL

SEQ ID NO: 28895 - protein, 88 aa, Hordeum vulgare
VLKQSDVGTLGRIVLPKKEAETHLPELKTGDGISIPIEDIGTSQVWSMRYRFWPNNKSRMYLLENTGDFVRSNELQEGDFIVLYSDVK

SEQ ID NO: 28896 - protein, 314 aa, Arabidopsis thaliana
MGGSREFRAEEHSNQFHSIIAMAIWLGAIHFNVALVLCSLIFLPPSLSLMVLGLLSLFIFIPIDHRSKYGRKLARYICKHACNYFPVSLYVEDYEAFQPNRAYVFGYEPHSVLPIGVVALCDLTGFMPIPNIKVLASSAIFYTPFLRHIWTWLGLTAASRKNFTSLLDSGYSCVLVPGGVQETFHMQHDAENVFLSRRRGFVRIAMEQGSPLVPVFCFGQARVYKWWKPDCDLYLKLSRAIRFTPICFWGVFGSPLPCRQPMHVVVGKPIEVTKTLKPTDEEIAKFHGQYVEALRDLFERHKSRVGYDLELKIL

SEQ ID NO: 28897 - protein, 108 aa, Oryza sativa
MARRPARCYRYCKNKPYPKSRFNRGVPDAKIRIFDLGRKKANVDDFPLCIHLVSNEYEQLSSEALEAARICANKYLVKVAGKEGFHLRVRVHPYHVVRINKMLSCAGA

SEQ ID NO: 28898 - protein, 451 aa, Bacillus clausii
MAHIQFDYSKALSFFGEHEVAYMREAVRAAHKALHEKTGQGNDFLGWIDLPVDYDKEEFARIQKAAEKIRHDSDVLLVVGIGGSYLGARAAIEALNHSFFNQLPKEKRNAPQVIFVGQNISSTYLSDVLDLLDGKDVSVNVISKSGTTTEPAIAFRVFRDYLEKKYGKEEARKRIYATTDKERGALKTLANEEGYESFVIPDDVGGRFSVLTAVGLLPIAVSGLAIEDMMKGAADAREAFSTGELSENAAYQYAAIRNILYNKGKTIELLVNYEPHLHYVSEWWKQLFGESEGKDQKGIYPASVDFSTDLHSMGQYVQDGRRNLFETVLHVEAVDKHITIEEAESDLDGLNYLAGKTMDFVNKQAFKGTMLAHTDGNVPNLVVSIPKLDEYSFGYLVYFFEKAVAMSGYLLGVNPFDQPGVEAYKKNMFALLGKPGFEEEKNKLESRLTDN

SEQ ID NO: 28899 - protein, 246 aa, Nuphar japonica
GSIFGLDLDHLQPEQLCYVHCNFCNTVLAVSVPCSSLFKMVTVRCGHCTNLLSVNMRALLQPPPPPPQNHHFFPPSDNLPTDENQVAAAAMFLNPSIIKDSGASPVSCAANHTTTTARTTTVNKPPEKRQRVPSAYNRFIKDEIQRIKAGNPDITHREAFSTAAKNWAHFPHIHFGLMADQNMEKSNLQQQEGNDLIISNGFFTTAIMGFTPYYSLSLSLSLSLSRLSLLLTLKRHAPSTHVEWGV

SEQ ID NO: 28900 - protein, 396 aa, Triticum aestivum
  misc_feature (92)..(92): Xaa can be any naturally occurring amino acid
  misc_feature (111)..(111): Xaa can be any naturally occurring amino acid
  misc_feature (245)..(245): Xaa can be any naturally occurring amino acid
  misc_feature (352)..(352): Xaa can be any naturally occurring amino acid
  misc_feature (359)..(359): Xaa can be any naturally occurring amino acid
MAAPTSAIGFEGYEKRLEITFSEASIFADPHGRGLRALSRAQIDSVLDLARCTIVSELSNKDFDSYVLSESSLFIYSQKIVIKTCGTTMLLXLTIPRILELAEELCMPLGXPVKYSRGMFIFPGAQPAPHRSFSEEVDVLNRYFGHLKSGGNAYVIGDPAKPGQKWHIYYATEQPEQPMVTLEMCMTGLDKKKASVFFKTQADGHVSCAKEMTKLSGISDIIPEMEVCDFDFEPCGYSMNAINGXSAVSTIHVTPEDGFSYASYEVMGMDASALAYGDIVKRVLRCFGPSEFSVAVTIFGGRGHAATWGKKLEAEAYDCNNVVEQELPCGGVLIYQSFAANEEVAVSAGSPXSVFHCFXGRECARATLWAKEGKLANLLAWRAEEDSLEEGAVLCE

SEQ ID NO: 28901 - protein, 535 aa, Streptococcus agalactiae
MKKHWWHKATIYQIYPRSFMDSDGDGVGDIKGITSKLDYLEKLGITAIWLSPVYQSPMDDNGYDISDYQAIADIFGDMNDMDQLLQEANQRGIKIIMDLVVNHTSDEHAWFVEARENPNSPERDFYIWRDEPNDLTSIFSGSAWEYDKVSGQYYLHLFSKRQPDLNWENEALRHKIYDMMNFWIDKGIGGFRMDVIDLIGKIPDKGITGNGPKLHDYLKEMNRASFGKHDLLTVGETWGATPDIAKQYSNPDNEELSMVFQFEHVGLQHKPDAPKWDYSDGLDVPALKDIFTKWQTQLELGQGWNSLFWNNHDLPRVLSIWGNDSDNRKQSAKALAILLHLMRGTPYIYQGEEIGMTNYPFECLADVDDIESLNYAKEAMDNGVSEATILDSIRKVGRDNARTPMQWSQEHQAGFTKGTPWLAVNPNYQEINVEAALNDTESIFYTYQKLVALRKEHDWLVDADFKLLETADKVFAYVRQTDKERYLIVANLSDQNQSFEFPEAVKETIISNTEVQEVLSSNTLKPWDAFCIELF

SEQ ID NO: 28902 - protein, 829 aa, Solanum lycopersicum
MSGRRSSYTLLNQIPNDNFFQPPAPKFSAGAGVLPYGESSSAEKNRGKVFDLDLMDQRMMQSHNRVGSFRVPGSIGSQKQSTEGSFRGSSLSGENYVGTSFGHKNEGCGSSVARNWAQQTEESYQLQLALAIRLSSEATCADSPNFLDPVTDVLASRDSDSTASAVTMSHRLWINGCMSYFDKVPDGFYWIYGMDPYVWALCSVVQESGRIPSIESLKAVDPSKAPSVEVILIVRCNDLSLKELQNRIHSISPSCITTKEAVDQLAKLVCDHMGGAAPAGEEELVSMSKGCSNDLKDRFGTIVLPIGSLSVGLCRHRALLFKVLADIIDLPCRIAKGCKYCNSSDASSCLVRFEHDREYLVDLIGKPGVLSEPDSLVNGPFSISIPSPLRFPRYRQVEPTTDFRSLAKQYFLDSQSLNLLFDDSSAGAAADGDAGQSDRSCIDRNNVVSSSSNRDEISQLPPPPLNAWKKGRDKESQLSKMYNPRSMLNPVNMDEDQVLVKHVPPFREDAQSPMTRPDTVNDTRFLAGGGHVVSAIPSEELDLDVEEFNIPWNDLVLMEKIGAGSFGTVHRGDWHGSDVAVKILMEQDFHAERLKEFLREVAIMKRLRHPNIVLFMGAVIQPPNLSIVTEYLSRGSLYRLLHKPGAKKVLDERRPLCLAYDVANGMNYLHKRNPPIVHRDLKSPNLLVDKKYTVKICDFGLSRFKANTFLSSKTAAGTPEWMAPEVIRDEPSNEKSDVYSFGVILWELATLQQPWNKLNPPQVIAAVGFNRKKLDIPSVLNPRVAIIIEACWANEPWKRPSFSTIMDMLRPHLKSPLPPPGHTDMQLLS

SEQ ID NO: 28903 - protein, 423 aa, Prochlorococcus marinus
MNILQNLKESDPIISNLINSEKNRQETHLELIASENFASMAVMQAQGSVLTNKYAEGLPQKRYYGGCEFVDEIEELAIERAKQLFDADWANVQPHSGAQANAAVFLSLLKPGDTILGMDLSHGGHLTHGSPVNMSGKWFNAVHYGVDKETNKLNFNEIRDIALATKPKLIICGYSAYPRKIDFESFRRIADEVGAFLMADIAHIAGLVATKLHPNPIPYCDVVTTTTHKTLRGPRGGLILCKDKEFGKKFDKSVFPGTQGGPLEHIIAAKAVAFGEALKPNFVNYSKQVINNAKVLSSTLIKRGIDIVSGGTDNHIVLLDLRSINMTGKVADLLVSEVNITANKNTVPFDPESPFVTSGLRLGTAALTTRGFNDDAFVEVGEIIADRLLNPDDLLTEKKCKERVLTLCNRFPLYEVELEASIK

SEQ ID NO: 28904 - protein, 181 aa, Unknown
  Acinetobacter sp. ADP1
MSQSIYHIPVQTISGQDTSLDTYRGKVLLIVNVASKCGLTPQYEGLEKLYQDKQQQGLEILGFPANNFLEQEPGSNDEIQQFCSLTYDVHFPLFGKISVAGEDKHPLYQTLIEAQPERIGEGPWWKDLVDYGLTPNPKPEVLWNFEKFLINKNGEVVARFAPDITADDPRLVDAINAELAK

SEQ ID NO: 28905 - protein, 442 aa, Mycobacterium avium
MPALLWFRRDLRLHDHPALSAAADSDEVLACFVLDPRLQRSSGPRRLQFLGDSLRVLRDELDGRLLVTRGRPDIRIPEIAKAIGASSVHVSEDFTPFGKRRDARVRAALASVPLVATGSPYLVAPGRVTKPDGSPYQVFTPFLRRWRDTGWRPPVKTGAASARWLDPARLGITDCEIPDPGATLDLAAGEEAARNKWKSFVDNGLANYADDRHRPDIEGTSRMSAHLKFGTIHPRTLVADLDLRAAAARAYLRELAFRDFYADVLHHRPASAWRNWNSAFDAIRTDTGAEAGRRFAAWKAGETGFPFVDAGMRQLRQTGFMHNRVRMTVASFLVKDLHLPWQWGAHWFLQQLVDGDLANNQHGWQWCAGCGTDAAPYFRVFNPAAQGEKFDPSGDYIRRWVPELRCADDPHLRTGERPPGYPAPIVDHATERAEALRRYRSM

SEQ ID NO: 28906 - protein, 356 aa, Ustilago maydis
MTGQRFEFQFLLSSSISNTVFCLISTCSRTTSARIKAYGSTATTAHLTSARPTVACTDFHPPRHPFIIMSLFGTFPGSSRGPAAASALKDHMVGHQFSPYDSNGGSIAAVCGTDFCVIASDTRQSTGYNIQTRYKPKVFRLNDKATLATNGFAADAEALVSHVRQRLEMYRHAHGRSMPLHSIARMISTILYGKRFFPYYVYNILGGLDEEGKGAVYSFDPVGSYEREFCRAAGAAQSLIQPFFDNQIMFRNQTSTPERTVPTPGQMTLGEVLKIVVDSFTSATERHIEVGDGLEVFVVRTPASASGQGEGAKGAAAVDLSTLPSDVPFSVAEAVGGEDEQQQGAVMVIRRELKKD

SEQ ID NO: 28907 - protein, 161 aa, Pityopus californica
FLSEACDLIFDAASRGNLFLIVGTKKRVASLVARAAIRARCHYVNKKRLGGMLTNWSTTEKRLNKFRDLRMEQKMGRLERLPKRDAARLKRQLAHLQAYLGGIKYMTGFPDIVIILDQHKEYTALRECITLGIPTICLIDTNCDPDLVDLPIPANDDNRSS

SEQ ID NO: 28908 - protein, 171 aa, Pinus thunbergii
MATGAGAGAATVVSAFTGLKSTAQFPSSFKMSNAAAEWEQKTTSNGGRVRCMQVWPPFGNPKFETLSYLPTLTEEQLVKEVEYLLRNKWVPCLEFDLEGSISRKYNRSPGYYDGRYWVMWKLPMFGCTEASQVINEVRECAKAYPKAFIRVIGFDNVRQVQCISFIVHKPE

SEQ ID NO: 28909 - protein, 573 aa, Rhodospirillum rubrum
MADSAQDLAFTAENFESLLNEQLGESGGLEGSVLTGTVIGVSGDFAVVDVGLKSEGRVPLKEFSRGGDDAEIKIGDTVDVFVERYEDKDGLIVLSRDKARREEAWNELEKAFNDNQRVRGLIHSRVKGGFTVDLSGAIAFLPGSQVDIRPVRDIGPLLGQPQVFQILKMDRARGNIVVSRRAVLEETRAEERSKLMETLREGEILEGVVKNITDYGAFVDLGGVDGLLHVTDISWKRINHPTEALSIGQTVKVQVIRFNAETQRISLGMKQLEADPWEGVAAKYPVGTKFVGRVTNITDYGAFVELEPGVEGLVHVSEMSWTKKNVHPGKIVSTSQEVEVMILDVDPDKRRISLGLKQTMANPWSEFLEGHPIGTEVEGEIKNITEFGLFIGLTGDIDGMIHLSDLDWNRSGDEAVKDYKKGDVVQAKVLDVDVEKERISLGVKQLGEDPYREATADLRKNQIVTCVITMVQENGIEVDVNGAIGFIRKSDLARERADQRPERFAVGEKVDAKVINMDKSNRRMTLSIKAREMDEEKQAMAEYGSADSGASLGDILGAALKQAQEKARTGDDE

SEQ ID NO: 28910 - protein, 571 aa, Arabidopsis thaliana
MNHSTSDQSLYIESDDGDDERKHLSDDEDDDGTLSDTSDAYNQNQHHLSKASPYSTAWPKSYRQSIDMFGSVPSPNLGFLANSSMSRRGSSFMSSTLTRRHTPESLPCVTKPLLEDEEAPKHKLSTHSLLPSKPSSSMVVSHDMGISNDSSFGQAVLNGVNVLCGVGILSTPYAVKEGGWLGLIILFAFGILCFYTGLLLRYCLDSHPDVQTYPDIGHAAFGSTGRILVSVILYMELYAMSVEYIILEGDNLSSMFPNASLSIGGFHLDAPRLFALLTTLAVLPTVWLRDLSVLSYISAGGVIASVLVVLCLFWVGLVDDVGIHSKGTPLNLATLPVSVGLYGYCYSGHGVFPNIYTSMAKPSQFSAVLLASFGICTLMYAGVAVMGYSMFGESTESQFTLNLPQDLVASKIALWTTKESTYALTLSPVAMSLEELIPSNYGKSRFYAIAIRSALAISTLLVGLAIPFFVNLLSLTKFLDTDADTTASLFLEHLKEKSNPYSDLVSQTLQVKTIMKSCLGFIFNWDLYFTIISSEGVAGEGTLADSVAEFDELQTLVTEASFASRITDNCL

SEQ ID NO: 28911 - protein, 161 aa, Monotropa hypopitys
FLSEACDLIFDAASRGNRFLIVGTKKRVASLVARAAIRARCHYVNKKRLGGMLTNWSTTEKRLHKFRDLRMEQKMGRLERLPKRDAARLKRQLAHLQAYLGGIKYMTGLPDIVIILDQHKEYMALRECITLGIPTICLIDTNCDPDLVDLPIPANDDNRSS

SEQ ID NO: 28912 - protein, 183 aa, Pyrus pyrifolia
MASSMISSGTVATVSADRPAPAQARMVAPFNGLKSSSAFPVTRKSNDITSIASNGGRVQCMQVWPPLGLKKFETLSYLPPLSSESLAKEVDYLLRKNWVPCLEFELETGFVYRENHRSPGYYDGRYWTMWKLPMFGCTDSSQVLKELEEAKKAYPQSFIRIIGFDNVRQVQCISFIAYKPAGF

SEQ ID NO: 28913 - protein, 181 aa, Raphanus sativus
MASSMLSSAAVVTSQLQATMVAPFTGLKSSAAFPVTRKTNTDITSIASNGGRVSCMKVWPPIGKKKFETLSYLPDLSDVELAKEVDYLLRNKWIPCVEFELEHGFVYREHGSTPGYYDGRYWTMWKLPLFGCTDSAQVLKEVQECKKEYPNALIRIIGFDNNRQVQCISFIAYKPPSFTDA

SEQ ID NO: 28914 - protein, 177 aa, Silene latifolia
MASLMSNAAVVTASTAAQANMVAPFSGLKSTSAFPVSRKSNVDITSLATNGGRVNCMQVWPPRNLKKFETLSYLPTLSEESLLKEINYLLIKGWVPCLEFEVGPAHVYRENNKSPGYYDGRYWTMWKLPMFGCTDASQVAAEVVECKNAYPDAHVRIIGFDNKRQVQCISFIAYKPE

SEQ ID NO: 28915 - protein, 161 aa, Hemitomes congestum
FLSEACDLIFDAASRGNQFLIVGTKEGVADLVARAAIKARCHYVNKKWLGGLLTNWSTTEKRLHKFRDLKIKQKMGRLKHLTKGDTTKLKRQLSHLQAYLGGVKYMKRLPDIVIILDQHKEYIALRECITLGIPTICLIDTNCDPDLVDFPIPANDDARSS

SEQ ID NO: 28916 - protein, 141 aa, Triticum aestivum
MGSEANGGAAAIDLLRSAAPFLPDADLLLTPGTGLVLVDLVNGFCTVGAGNLAPVTPNKQIEKMVEESTRLAKVFCQRNWPVFAFLDTHHPDKPEPPFPPHCIIGSGEENFVPGYSTFFLLLLLLSLSQSMFSFYELILSC

SEQ ID NO: 28917 - protein, 436 aa, Arabidopsis thaliana
MASWIFKLLLLLQCVLVLIQHADSSSIIRYLPGFEGPLPFELETGYIGVGQKEEDQLFYYFIKSENNPEEDPLLVWLTGGPGCSSFSGLVYENGPLAFKVETYNGSVPTLVSTTYSWTKVANIIYLDQPVGTGFSYSRNPFADIPSDTGSVKRVNEFVRKWLAKHPEYFSNPFYVTGNSYSGKVIPAIVQEISNGNYICCKPQINLQGYVIGNPVAYYDHDKDFRIPFAHGVALISDELFESLKASCGGSYSVVDPLNTECLKLIEDYDKCVSGIYEELILKSKCEHTSPDCYTYRYLLSEYWADNETVRRALKVVKGSKGTWERCDYRVLSNQDIKSSIPFHINNSIRGYRSLVISGDHDMTIPFLGTQAWIRSLNYSITEKWRPWMILDQVAGYTKTYANKMTLATVKGGGHTLEYKPEENSVLFKRWISGQPL

SEQ ID NO: 28918 - protein, 594 aa, Streptococcus equi
MLYPILTKTRKIYDLGGLWQFKLGDHNPQELLASDELMVVPTSFNDVVVDKDKRNYIGDFWYERFVDVPDLAADEELVLRFGSVTHNATVYVASFRAHKGGFTPFEVLVPEDLYRDSRIKVSVCANNILDYTSLPVGNYSEELQEDGSIKKVVKENFDFFNYAGIHRPVKLMVRPKCHISDITITSDLSEDMTSALVKVSVETSAAVDEVKVTILDEEHRLVAKVVDGKARLDSVRLWEVLDAYLYTAHVELIVDGNVVDSYDESFGVRSIAVEEGQFLLNGKPVYFKGFGKHEDTFINGRGLNEAANLMDMNLLKELGANSFRTSHYPYSEEMMRLADRMGILVIDEIPAVGLFQNFTASLDLSPKDNGTWSVMKTKEAHEQAICELVKRDKNHPSVVMWVVANEPASHEEGAHEYFEPLIALYKALDPQQRPVTLVNLLLATPDRDKVMDLVDVISLNRYYAWYVDHGDLIKGEVGLRQELLEWQKKFPNKPILMTEYGADTLPGLHSMWDIPYTEEFQCRFYEMSHRVFDEIPNLVGEQVWNFADFETNLMIFRIQGNHKGLFSRNRQPKHVVGLFKERWNTIPHYNYKKK

SEQ ID NO: 28919 - protein, 651 aa, Burkholderia mallei
MRRGMKLLLVDNLVMPEEGSLAYLDVHPHLGLLALAAVAEADGHRVRIYDPKRLIRDGTLAYDATLYERASRAILAERPDAVGFTALGCSFLFALNVAALLKRREPDLPVLLGGPHATMLHRQILERFPQFDIIVRYEADEILPAVLDCLEQRTFDVIPGLSWRATGRGAPLRFTDGKPKVEELDRLPIASYDHYPVDDLGFSMLRIEAGRGCPFACTFCSTAGFFQRSFRLKSAERLVHELDILHRRYRVSDFKLDHDMFTVNRHKVMAFCEAVAGRGYRWRASARIDCVDEALLRKMADAGCVNLYFGVETGSERMQTICRKRLDLRLVEPILAAADSFGIETTASFITGYPQESGQDQDDTLDMIGRCARRPSCLTQLHMLAPEPGTPLFDEHGAQIAYDGYGGPYNTRLLGPEDEREVLDHPDIFQTYYYYPAALPRARHIFAVEAVDVLRRAGPIILAYALREFGGRLSRLISAWRRFADETSPGALPDAAGLEAFVAARFGRGHHLHSLFRYALRLSAARAPADVVAEGPYEPDRPCMLAENVGLLEDIHNCEALVDRLRRSNDGAPALGDADVGGLGAYIVRADGEAVTGYWVESGIAAILDLFRAPRSCRAAAQWLAHVTRNDGVDASIFELLLRRGILVPAR

SEQ ID NO: 28920 - protein, 322 aa, Unknown
  Synechococcus sp. RS9917
MPIADDITALVGRTPLVRLNRLPAACGCQAEILAKLESFNPTASVKDRIAGAMVQAAEASGTIQPGRTVLVEPTSGNTGIALAMVAAARGYRLILTMPDTMSTERRSMLRAYGAELQLTPGVEGMQGAIALARQLVAEIPGAYLLQQFDNPANPAVHAATTAEEIWADTGRALDAFVAGVGTGGTLTGCAQVLKRRCPGLQVVAVEPAASQVLAGGAPGPHRIQGIGAGFVPPVLEAGLIDEILAISDEEAMAMGRRLAREEGLLSGVSSGAAVAAALRIGQRPAMAGRRIVVILASFGERYLSTPMFSSAPAPPARGDGQL

SEQ ID NO: 28921 - protein, 305 aa, Rhodobacter sphaeroides
MIGILGAGAFGTALAVTLGREQPVTLWARGGTPRLAVDLPEQVQLTADFGEALAGTVLLAVPMQALGGLLRAEAARLQGRALVACCKGVDLATGLGPTGLIAEACPGSPAAILTGPSFAADIARGLPTALTLATQDEAAGEALQRQLSTAALRLYRTTDTVGAELGGALKNVIAIAAGVVIGAGLGQSARAALMTRGYAEMQRLALALGARPETLAGLSGLGDLVLTCTSDQSRNFRYGQALGAGAAFDGSVTVEGRATARAVVDLAVRHGIDMPIAAMVDALVEGRVTLPQAIQSLLSRPLKQE

SEQ ID NO: 28922 - protein, 806 aa, Solanum lycopersicum
MSGRRSSYTLLNQIPNDNFFQPPAPKFSAGAGVLPYGESSSAEKNRGKVFDLDLMDQRMMQSHNRVGSFRVPGSIGSQKQSTEGSFRGSSLSGENYVGTSFGHKNEGCGSSVARNWAQQTEESYQLQLALAIRLSSEATCADSPNFLDPVTDVLASRDSDSTASAVTMSHRLWINGCMSYFDKVPDGFYWIYGMDPYVWALCSVVQESGRIPSIESLKAVDPSKAPSVEVILIVRCNDLSLKELQNRIHSISPSCITTKEAVDQLAKLVCDHMGGAAPAGEEELVSMSKGCSNDLKDRFGTIVLPIGSLSVGLCRHRALLFKVLADIIDLPCRIAKGCKYCNSSDASSCLVRFEHDREYLVDLIGKPGVLSEPDSLVNGPFSISIPSPLRFPRYRQVEPTTDFRAAADGDAGQSDRSCIDRNNVVSSSSNRDEISQLPPPPLNAWKKGRDKESQLSKMYNPRSMLNPVNMDEDQVLVKHVPPFREDAQSPMTRPDTVNDTRFLAGGGHVVSAIPSEELDLDVEEFNIPWNDLVLMEKIGAGSFGTVHRGDWHGSDVAVKILMEQDFHAERLKEFLREVAIMKRLRHPNIVLFMGAVIQPPNLSIVTEYLSRGSLYRLLHKPGAKKVLDERRPLCLAYDVANGMNYLHKRNPPIVHRDLKSPNLLVDKKYTVKICDFGLSRFKANTFLSSKTAAGTPEWMAPEVIRDEPSNEKSDVYSFGVILWELATLQQPWNKLNPPQVIAAVGFNRKKLDIPSVLNPRVAIIIEACWANEPWKRPSFSTIMDMLRPHLKSPLPPPGHTDMQLLS

SEQ ID NO: 28923 - protein, 324 aa, Anaplasma phagocytophilum
MRVTVLGAGAFGTALSVALYNSCCSVALWSRNKRVLEELRNTGMNSLYLPGCLVPKEIELIPDVESALKCASVLLLCVPTQELRNLCNDVRNTAALDASVPVLVCSKGIENKSLKFAGEVIEELLPDNPVFVLSGPALAKEMVRGLPCAMVLAGRDESLAASLAEKLSSAVMSIAPSTDYVGVQIGSVLKNIIAIACGIVIGKGLGYNASAMVVVRGIAEIQAVSTAKSESVDLSTIIGLACLGDLVLTCTSASSRNMSFGLAIGKGQDIASRNDSLVEGAESAQSIDRLSNTLGIHLPVCSAIAKLLRGELDTDQVINQLLFA

SEQ ID NO: 28924 - protein, 79 aa, Triticum aestivum
PDILENFSKEYMYLACVAYVKKVKKGPFVEHSPMLDDISGVANWKKVNSGLLKMYKAEVLEKVPIMQHFLFGSLIKWED

SEQ ID NO: 28925 - protein, 666 aa, Aspergillus oryzae
MSLAQNHYVIKLPVTPSRTRSLEPRAIAQQWIANLDVLLNRGDFSQLPELFHQESWWRDMLALAWDLRTIQNCNNIEDYLRQNQPRSQLSAFRLQHEGKFQPTFDRPVEGLSWISSMFFFETRVGRGTGVLRLTQNDAGAWKAYSIYTSLQEFKDFEEPLGSKRPEGTIETMPGGLSQGNWLERRQRQLEFMDEEPTTLVVGAGQAGLNMGARLQSLGVSCLIVDRNERIGDNWRKRYRSKNPANKTLLQTLVTHDPAEFTHMAYLPFPKNWPQFTPKDKLGDWFEAYASIMELNVWLQTSIKSAVYDDAKAQWSVVVTRGDGSERTLHPRHLIWCTGHSGEPKVPTFPGQPQFKGQVYHGSQHNDASKHDVRGKKVVVVGTGNSGHDIAQNFYENGAQVTMLQRSGTYVITAEKGVFMMHEGLHEDNGPPTEEADIMSESLPYPVQFALAVHFTKRAYAAERDILEGLQKAGFELDFGVDGAGISRAYMTRGGGYYIDVGCSPLIADGKIKVKRSPKGITGFNEHSLILEDGSSLEADIVVLATGYDNMRTTVRKILGDTVADRCKDVWDLDEEGEVNAVRSLAHLTLTVYPFLYPTIHSVSILSAQLAILTVIQMWRPSGHPGFWFHGGNLALCRIYSKFLALQIKAIEAGLVSQGQDQTQPKL

SEQ ID NO: 28926 - protein, 212 aa, Salmonella typhimurium
MSLFDKKHLVTQADALPGRNTPMPIATLHAVNEHSMTNVPAGMEIAYFAMGCFWGVERLFWQLPGVYSTAAGYAGGYTPNPTYREVCSGQTGHAEAVRIVYDPAVISYEQLLQTFWENHDPTQGMQQGNDHGTQYRSAIYPLTPEQNAAAHASRERFQSAMTAAGDHRPITTEIAHATPFYYAEDEHQQYLHKNPYGYCGIGGIGVCLPPDA

SEQ ID NO: 28927 - protein, 382 aa, Anaplasma phagocytophilum
MGSNDYYDLLGVSRGASEEEIKKSYRKKVFEYHPDRNPGNKEAEEKFKKISEAYDVLTDSDKRAAYDRYGHSAFANGMGGNQGFTGGFDGGFSTDFSDIFNDFFGGGFGKTSRQSSRENMRGSDLRYDIEVTLEDAFKGVKVPISYVTHVQCSHCSGSGGEGTAKSVKCGTCNGAGRIRTRKGFLTIEELCHTCSGEGEVVKNKCKRCAGSGRVRNEVGILVTVPRGIENGNKVRVNGKGEAGYRGARSGDLYVYVVVKDHKFFTRRGMDLYCNVPIKMTLAALGGEIEMPSIDGTWTKLKIPEGTQSNDKLRMRGKGMPDIQGGERRGDMYVQVTVETPVKLTKKQEELLKQFEDESNANSSPKFSGFFQKIKGIWKDISS

SEQ ID NO: 28928 - protein, 584 aa, Synechococcus elongatus
MSEGRHRDIQPSWVAAGLMVLRARSWERLRFEVEYGLGHGTTSNAYLVQGDRTILINPPGASFTEIFLNRLEAQCPIGELDAVLLSHVSPNRVSTLKELMRLNPGLQVIVSNPAAQALEKLWQVEAQEAPIPPLDLKIIRTEESLDLGRGKVLQLLPTPIPRWPDGLCVLDEQTGWLLSDKFFAAHLCQDQIFDQGWTSFREDQRYYFDCVMAPQVRQVQTVLAKFSRLPIQGYAPSHGPLIRYGLHDLTAAYVSWSDRQLQQPQMVALLYASAYGSTATIAEAIAQGITKAGVRVEALNCEVESMDDIRRTLERCDGVVIGSPTLGGHAPTPIQTALGTILATVARDKPVGVFGSFGWSGEAIDLLESKLKDAGFRLAFEPIRVRFKPTTATLKICEESGTDLAQALQRQRRQVSRQSSSKLQDSETEATAQAVGRILGSLCVLTTQKEDVRSGMLASWVSQATFNPPGISVAVARDRAVESLLHQGDRFVLNVLGEDKNLAIQKHFLKPFSPGADRLEGIESSPSDQGHPILAEAIAWLECRVANRMECGDHWLVYAVVESGQVQDPEVRTAIHHRKSGSYY

SEQ ID NO: 28929 - protein, 247 aa, Arabidopsis thaliana
MELFIGPRRHHPFDVDGTIPSNHLHNFEHSSISMSFLVYAVLALVLDRARPRAAASEGLTMLAAAAAFSQQLLLFHFHSTDHMGVEGQYHVILQVVIFVSLLTTIMGIFLPKSFLVSLVRSSSIAFQGVWLIVIGCMLYTPSLIPKGCYIHDEGRHIIVKCSTEEALHRAKSLVNLEFSWLFVTNTLFVVTLYLILDRVYGENVEYSSLTTNNQTYQDDEEQHFESKSTQKTSFVQMGKLVGHGQKM

SEQ ID NO: 28930 - protein, 261 aa, Picea glauca
MEDMNMNIGGAATFYGVNMNEYGDTGVGSMMALMTEQEPGNESIMSTMTMTIPSSAFSSYSHAGQVEGLLSAAAATMFNQGGHHHHQKHLVGGHFPPEQLVMNEQAAVISDSSLSSVKTEVCSNQLEFHRKTSGGGRSCCPQPSLVVRAPQQQQQQHHHHQEASRMVTSLEVDIDSACSSNPNDSIDTLKTKIACHPHYPQLLAAYMDCQKIGAPPEVVTVLDEISQENQLGRHLATMDIGVDPELDQFMEAYCQMLIKYH

SEQ ID NO: 28931 - protein, 571 aa, Synechococcus elongatus
MVATTPAPRLSLAVEAIGPQTTTIRSLDWDRSRFDIEFGLQNGTTYNSFLIEADRKALVDTSHAKFQATYVDQLRELTDLSTLDYLIISHTEPDHSGLVGDILAIAPNVTVVGSKVALQFLENQVHRPFQKLQVKNGDRLDLGQGHELEFVSAPNLHWPDTIFTYDPASQILFTCDAFGMHFCDERTFDEDLQQIEGDFQYYYECLMAPNARSVLAALKRMKALGEITTIATGHGPLLRRNLQEWVDRYQHWSEQKATAETSVLIGYLSDYGYSDRLSQAIGRGLVKTGVAVEMVDLRAVDPQELIEAVSSARGIVLGTPPSQPSEAVATALSTIFAAAHNKQAIGLFDSYGGDDEPIDALLAQFRNLGLHTAFPPIRVKDQPTEAIYQQCEESGTDLGQWLTRADAIQTMKSLNSDLDKALGRLSGGLYIITARKGEVSGAMLASWVVQASFKPLGFTVAVAKDRAIESLMQVGDRFVLNILGEDNYAPLMKHFLKRFPPGADRFAGVETQTASNGSPILTAALAYLECEVASRMDRSDHWLVYCQVEQGRVSRADVRTAVHHRKVGNHY

SEQ ID NO: 28932 - protein, 327 aa, Saccharum spontaneum
MGLSTAYSPAGSGLVPAPLGAGAGAARRRSAQVRRPRLATVRCSVDAAKQVQDGVATAVAAEAPASRKECFGVFCNIYDLKAEDKTKSWKKLVNIAVSGAAGMISNHLLFKLASGEVFGQDQPIALKLLGSERSFQALEGVAMELEDSLYPLLREVSIGIDPYEVFQDVDWALLIGAKPRGPGMERAALLDINGQIFADQGKALNAVASRNVKVLVVGNPCNTNALICLKNAPNIPAKNFHALTRLDENRAKCQLALKAGVFYDKVSNVTIWGNHSTTQVPDFLNAKIDGRPVKEVIQDTKWLEEEFTMTVQKRGGALIQKWGRSSA

SEQ ID NO: 28933 - protein, 244 aa, Prochlorococcus marinus
MDLLEMTNKDQEDHYKSTLNLVNIFVKSNQRKRINLLSDIESDVENIFLIGKKIFDDFDQKGDDWAAGWLLQVLKKHKPIFFNDKKYNNWFFTSSDKDINYEELQLRLLEQNFEDADRLTSSYLRKLAGKLAENRGYVFYSEVNNMSGTDLQTIDRLWTIYSNGRFGFSIQAKLLKSVGKKYELLWPKIGWKKDGYWTRYPSSFSWSLEAPEGHMPLINQLRGVRLMDSILRHPAISLRHNNIL

SEQ ID NO: 28934 - protein, 101 aa, Saccharum officinarum
ADAIKSLVTPTPEGDWFSTGVYTTGNPYGIAEDIVFSMPCRSKGDGDYELATDVSMDDFLWERIKKSEAELLAEKKCVAHLTGEGNAFCDLPEDTMLPGEV

SEQ ID NO: 28935 - protein, 404 aa, Methanothermobacter thermautotrophicus
MKARAEKIADGLYWTGVLDWDIRNYHGYTLQGTTYNAYLVFGDEGVALIDNSYPGTFQELMARMEDAFNREGREMRVDFIVQNHVERDHSGVLVELHRRFPEAEIHCTEVAVEGLLKHYPALEGTEFRTVKTGDSIDLGGRTLTFLEAPLLHWPDSMFTFLDTGILFSNDAFGQHLCYPQRLDTEIPEYILMDAAKKFYANLITPLSKLVLRKFDEVKELGLLDKIGMIAPSHGQIWTEPMKIIEAYAAWATGKVKKKVTVIYDTMHHSTAMMAHAIAEGAMSEGADVRVYYLHEDDRSEIVKDILDSHAIALGAPAIYDEPYPSVGDLLMYLRGLKFNRTGQRRAMVFGSMGGRGGATGTMQKLLADAGFDVMEADEIYYVPNNEELDACFEAGRRLAGDLNE

SEQ ID NO: 28936 - protein, 319 aa, Vibrio vulnificus
MSDMKHSKLLILGSGPAGYTAAVYAARANLNPVLITGMQQGGQLTTTTEVENWPGDPEGLTGPGLMDRMKEHAERFETEIIFDHINEVDFSTRPFVLKGDAASYSCDALIISTGASAKYLGLESEEAFKGRGVSACATCDGFFYRNQKVAVVGGGNTAVEEALYLSNIAAEVHLIHRRDSFRAEKILINRLMDKVQNGNIVLHTDRVLDEVLGDEMGVTGVRLKDVKTGGTEELDVMGAFIAIGHSPNTQIFQGQLDMKDGYILVKSGLEGNATQTSVEGIFAAGDVMDHNYRQAITSAGTGCMAALDAERYLDSLNDK

SEQ ID NO: 28937 - protein, 535 aa, Candida albicans
MPSPDLTDPPSAPKQRRRSFMDYGGPNSINNFASSYSRAQQYIGTSFMEQGGEYMESPPQIPSRPLHEDNEAFISSDDNSIRSDNNSNNQTEHMDFPLPPPIDWSNNSVFDETSELLPTLSRVSTKRHSFSLITGNSTAAQTIFNSINTLIGIGMLSLPLGFKMSGWLFGSLLLVVSAFLTNTTAKYLGKILYRHQELMTYGDIAYAYGGKYFSYLVTLFFVIDLFGASLTLIILFADSFTIVWPHVPALKAIIVAVVFVLSLLPLSMLSIFSLLGIISTVGIILSVFICGFLVDTSPGSLLIPATTTLLPPNPINLLFSLGIFMAPWGGHPVFPELYRDMRHPFKFTKSSNISFLVTYLLDFSIGATGYLMYGLMVDDSIVKSIMQNPNYPPIINSILCILMGILPISKLPLVTKPIITSYENIFGITAKYVKLDENGKLTDTYGPTRVFSRLLFCCVLLISALLLTSFGKLVAFLGSAICYTVCLTLPLLFYLKLNRSSVGKLEGLLIKIGIVFSITATILGTYASIGLTIPE

SEQ ID NO: 28938 - protein, 101 aa, Themeda quadrivalvis
ADAIKSLVTPTPDGDWFSTGVYTTGNPYGIAEDIVFSMPCRSKGDGDYELATDVSMDDFLWERIKKSEAELLAEKKCVAHLTGEGNAYCDVPDDTMLPGEK

SEQ ID NO: 28939 - protein, 161 aa, Monotropa hypopitys
FLSEACDLIFDAASRGNQFLIVGTKKEFADLVSRAAIKARCHYVNKKWLGGMLTNWSTTKKELHKLRDLKIKHKMGRLKQLKKRDVTGLKRQLAHLQEYLGGIKYMTRLPDIVIILDQHKEYISLLECITLGIPTICLIDTNCDPDPVDLPIPANDDTRSS

SEQ ID NO: 28940 - protein, 178 aa, Trifolium repens
MALISSAAVTTINRAPVQANLATPFTGLKSSAGFPVTKKNNDITSITSNGSRVNCMQVWPPVGKKKFETLSYLPPLTDEQLLKEVEYLLRKGWVPCVEFELEKGFVHRQYNSSPGYYDGRYWTMWRLPLFGTTDAAQVLKEVAECKAEYPEAFIRIIGFDNVRQVQCISFIASTPKVY

SEQ ID NO: 28941 - protein, 331 aa, Thermotoga maritima
MIKNQWYVVLSSRELKKGQLIGVTRFGEKLAFWRDSNGKVHCISDICCHRGASISHGKVLSNGERVMCPFHGFEYDSQGRVRTIPANGRNTPVPENFRVKSYPTYELADFIWIWYGDREPEKPPKYFDDITDELVYTEFKEVWNVHYSRAIENQLDPIHLPFVHYNTIGRGNRTVVDGPIVEWKDDEMFYFYVFNRIDDGTPARKPEEMDPKRKSKVYLEFKFPNIWQNHISEKIRVTAAFTPIDDDHTMIYLRFYVGLTGIKFLDKLIAVLGKPFNKIVLHQDKRVVETQIPKRSELRMGENLIPGDAPILEYRKKREALKSMQQNNRVK

SEQ ID NO: 28942 - protein, 379 aa, Bacillus licheniformis
MKEQCVAMLLAGGKGSRLNALTKNLAKPAVPFGGKYRIIDFALSNCANSGIHHVGVLTQYQPLLLNSYIGIGEPWDLDRNDGGVSILSPYAEASEVKWYKGTASAIYENRHFLKELQPEHVLILSGDHIYKMDYGKMLEYHAEKQADATIAVIEVSWAEAGRFGILHTNDKMEITSFEEKPKYPKSNLASMGVYVFKWSVLEDALERDEKNSASSHDFGKDVIPALLEENKRLNAYPFKGYWKDVGTVRSLWEANMDLLGDHPPLDLFERNWRIYSVSPNLPPQFVADLAEIKESLVSEGCTVYGSVTRSVIFQRVAIGRHSAIKRSVVMHDVSIGEYVEIENAIVSAGIRIPDGFCAKPEDGEVLLITEEYVKKHKVV

SEQ ID NO: 28943 - protein, 326 aa, Coccidioides immitis
MEYDKSGRALFGAVRPSFQSRYHSTETETVAQISQSTDPIQAVQPKASAEEQPALSEQFRNLTARRVRFNELGSQVKSAYEPENLLRSPPGPSDITLELLLASQSHLGHATSLWNPRNSSYIFGIRDGIHIISLEVTAAYLRRAAKVVEEVARRGGLILFVGTRKGQRRAVVRAAELAQGYHVFERWVPGSITNGQQILGHCELKVVDEFDNELPRYKENVSEQPVLRPDLVVCLNPIENEPLLTECRAYNIPTIGIIDTDADASMVTYPIPANDDSLRSVAVIAGVLGRAGEAGQKARLQQSRTGKLPYERVSMKKLMPDSEGSS

SEQ ID NO: 28944 - protein, 121 aa, Monotropa uniflora
FLSEACNLVFAAASREKQFLIIGTNKDIADLVLRSALKARCHYVNKKWLGGILTNWVTTEKQLNKLRDLKIEQKGVKLKSLLIQKRQSTKLRKQLVHLQTYFGGIIYMTRLPDIVIILDQQ

SEQ ID NO: 28945 - protein, 177 aa, Rhodopirellula baltica
MRTLIDESQLDDGVSKLAKEIDATYGDRPITVVAVMTGSLVLFADLIRRLSMPQRVGVIHASSYRGGTQAGKLEIDSKMLIDVQNRDVLLVDDIYDTGATLTKLSGAIADMGASSVSTAVLLRKLRPEQIGPKPDFVAFEIPDEFVVGYGLDYLDMYRNLPFIGVLEPDEIEATARQ

SEQ ID NO: 28946 - protein, 164 aa, Methylococcus capsulatus
MNIYEFEVRTLEGETVRLDGYRGKVLLIVNVASRCGFTPQYAGLEALYRRHRNAGLVILGFPCNQFGGQEPGSETEIRRFCSSRYEVSFPLFAKIEVNGEHTHPLYAYLKSAQPGLLGSEAIKWNFTKFLVGRNGEVVKRYAPTATPESIEPGLLPLLTVGSGG

SEQ ID NO: 28947 - protein, 121 aa, Monotropa uniflora
FLSEACNLVFAAASREKQFLIIGTNKDIADLVLRSALKARCHYVNKKWLGGILTNWVTTEKQLNKLRDLKIEQKGVKLKSLLIPKRQSTKLRKQLVHLQTYFGGIIYMTRLPDIVIILDQQ

SEQ ID NO: 28948 - protein, 339 aa, Corynebacterium efficiens
MIERVWQLVSVAVMGAGSWGTTLAKVFADAGNTVQLWARRESLAETIRTSRENPDYLPGITLPDSVIVTSDAQAALDGCSIVVLGIPSQALRTTLVEWRDLISPDATLVSLAKGIEKDTHLRMSQVIAEVTGADPSRIAVLSGPNLAREIAEGQPAATVIACEDENRAKLVQAAVAAPYFRPYTNTDVIGTELGGACKNVIALACGIAHGFGLGENSNASLITRGLAEIARLGEAMGADPRTFAGLAGMGDLVATCSSPLSRNRTFGDRLGRGESLEQAREATHGQVAEGVISSQSIHDLAVGLGVEMPITQAVYAVCHQGMAVREMVDALMGRSKKAE

SEQ ID NO: 28949 - protein, 481 aa, Nicotiana alata
MSLTSPNFVIGFCFVILFGNAASIDYGIALTKSLLYFEAQRSGKLPPNQRVQWRGDSALNDGKDAGIDLTGGYYDAGDNVKFGFPMAFTVTMLAWSVVEFGEKLEAKKELTNALNAIKWGTDYFIKAHTQPHIFYGEVGDGNSDHQCWERPEDMTTPRNSYKVDEQHPGSDLVGETAAAFAAAAIAFNKWNSSYSSQLLVHAKELFDFANKFQGQYQTSISVAGQFYGSTGYEDELLWAATWLLKATQDKTYLDYINGQATRSMFSWDDKYVGAQVLIAKNLLEKKFPGNESLLNQYKKNAEEFICNCIQKGNNNINKTNGGLLWWQPWNNLQYVTAATFVITSYADTLFATKNSLQCATGTVEFSNLIMFVKSQVDYILGENPKKMSYMVGFGTNYPQKIHHRGASIVSIKKDRATVSCNEGFNLWFYKNAPNPNILDGAIVGGPDLSDNYNDSRTNFQQAEAATANTAPLVGVLARLTE

SEQ ID NO: 28950 - protein, 248 aa, Solanum melongena
IFQVVDHGIDDQLISQMTSLAKQFFALPPEEKLRFDMSGGKKGGFIVSSHLQGEVVQDWREIVTYFSYPIGCRDYSRWPDKPQGWIAVTEKYSEKLMDLACKLLQVLSEAMGLEKEALTKACVDMDQKVVVNFYPKCPQPDLTLGLKRHTDPGTITLLLQDQVGGLQATKDNGKTWITVQPVEGAFVVNLGDHGHFLSNGRFKNADHQAVVNSDSSRLSIATFQNPAPNAIVYPLKIREGEKAIMDEP

SEQ ID NO: 28951 - protein, 1121 aa, Ralstonia eutropha
MKRLTEPANALLLNADPLWYKDAVVYQLHIKSFYDANGDGVGDFAGLLAKLDYLVDLGIDTIWLLPFYPSPRRDDGYDIADYRNVHPDYGTLAEARRFVGAAHARGIRVITELVINHTSDQHPWFQRARKAKPGSAARRYYVWADNDQAYAGTRIIFCDTEKSNWSWDPVAGAYFWHRFYSHQPDLNFDNPQVMNEVLSVMRFWLDIGVDGLRLDAVPYLVEREGTTNENLPETHTAIRHIRSHLDSHYQGRVLLAEANMWPEDAQQYFGRSSTGDKGDECHMAFHFPLMPRMYMAIAREDRFPITDIMRQTPELPTDCQWAIFLRNHDELTLEMVTSSERDYLWEVYASDRRARINLGIRRRLAPLMERDRRRIELMNSLLFSMPGTPVIYYGDEIGMGDNIHLGDRDGVRTPMQWSPDRNGGFSHADPERLVLPPLQGPLYGYEAVNVEAQARDPHSLLNWMRRMLALRRKHRAFGRGTLRFLFPGNRKILAYLREYEGEHILCVANLSRAPQAVELDLSAFNGRVPVEMMGATPFPAIGTLTYLLTLPPYGFYWFVLSEDAHPPAWHVSAPEQMPDQITLVLQNKGRPELTEAARRMLNDEVLPPYIRRRRWFGAKDDSIQRATLAYMAPFTKGTTGEEIYLGEVEVRLSGGRTERYQLPLGVLWDRESADSVSQLAHGLSMARVRQGSRVGLATDGFVLEPFAREVIRALRADAELQGPQETIRFRSEPGLSAVQPEQEEIQWMSAEQSNSSLAYNNTAVLKLVRRLSGGTHPEVEMTRYLTAQGYPHSPPLLGEVVRTGADGVPHTLMMVQGYILNQGNGWDWTLDYLSRVIDDALPAQESADEFAEAMNGYATMAGTLGRRLAELHAVLARPTDDPAFAPRPATDAETRQWAEQAMAAITHALALLEKRAQNDPKSASKRFMADVDTLLKARDALPALVNRLAAAAPGSLQTRFHGDFHLGQVLIAQNDTYLVDFEGEPGQPLDWRRRKTSPLRDVAGLLRSIDYAAATVGTDRQERTHAELPPALAERRGGLLERFRETASDAFLGCYRRHMEASGTPWADNAQFQPLLDLFLLERAAYEVEYEAANRVAWIDLPASGLARMVRKLMAGNLEAQ

SEQ ID NO: 28952 - protein, 442 aa, Arabidopsis thaliana
MAIIQLGSTCVAQWSIRPQFAVRAYYPSRIESTRHQNSSSQVNCLGASKSSMFSHGSLPFLSMTGMSRNMHPPRRGSRFTVRADADYYSVLGVSKNATKAEIKSAYRKLARNYHPDVNKDPGAEEKFKEISNAYEVLSDDEKKSLYDRYGEAGLKGAAGFGNGDFSNPFDLFDSLFEGFGGGMGRGSRSRAVDGQDEYYTLILNFKEAVFGMEKEIEISRLESCGTCEGSGAKPGTKPTKCTTCGGQGQVVSAARTPLGVFQQVMTCSSCNGTGEISTPCGTCSGDGRVRKTKRISLKVPAGVDSGSRLRVRGEGNAGKRGGSPGDLFVVIEVIPDPILKRDDTNILYTCKISYIDAILGTTLKVPTVDGTVDLKVPAGTQPSTTLVMAKKGVPVLNKSNMRGDQLVRVQVEIPKRLSKEEKKLIEELADMSKNKTANSTSR

SEQ ID NO: 28953 - protein, 66 aa, Datura stramonium
VYILDQAEEEGHDLPYSCRAGSCSSCAGKVTAGTVDQSDGNYLDDDQMADGFVLTCVAYPQSDVTI

SEQ ID NO: 28954 - protein, 185 aa, Cryptococcus neoformans
MTFFDSIASKFGYESLPGDVANKSFYDLKAKLPGSKGDLDFSTLKGKVVLIVNTASKCGFTPQYTGLEELHKTYGDKGLVVLGFPSNEFGGQEPGSDDDIAQFCTLNHGVTFPLMKKSEVNGKNMNEVFAWLKSQKGENVGGLAGTTAIKWNFTKFLINKEGKCVGRYGSSTKPEKLKEEIEKLL

SEQ ID NO: 28955 - protein, 261 aa, Picea glauca
MEDMNMNIGGAATFYGVNMNEYGDTGVGSMMALMTEQEPGNESIMSTMTMTIPSSAFSSYSHAGQVEGLLSAAAATMFNQGGHHHHQKHLVGGHFPPEQLVMNEQAAVISDSSLSSVKTEVCSNQLEFHRKTSGGGRSCCPQPSLVVRAPQQQQQQQHHHQEASRMVTSLEVDIDSACSSNPNDSIDTLKTKIACHPHYPQLLAAYMDCQKIGAPPEVVTVLDEISQENQLGRHLATMDIGVDPELDQFMEAYCQMLIKYH

SEQ ID NO: 28956 - protein, 1039 aa, Zea mays
MRPSPPLLLFVLLHFALLSTIAAADGNGNGNGNGDLRGDAMALLALKAALSCRPGALRSWSVANAGSVCAWAGVRCAAGRVVAVDIANMNVSDGTPVSARVTGLGALETISLAGNGIVGAVAASALPALRHVNVSGNQLGGGLDDGWDFASLPGLEVLDAYDNNFSAPLPLGVAALPRLRYLDLGGNYFTGEIPAAYGAMPAVEYLSLNGNNLQGRIPLELGNLTTLRELYLGYYNVFDGGIPPALGRLRSLTVLDASNCGLTGRIPAELGALASLGTLFLHTNQLSGPIPPELGNLTSLAALDLSNNALTGEVPRSLASLTSLKLLNLFLNRLHGPVPDFIAALPRLETVQLFMNNLTGRVPAGLGASAALRLVDLSSNRLTGFIPETLCASGQLHTAILMNNFLFGPIPGSLGTCTSLTRVRLGQNYLNGSIPAGLLYLPRLSLLELHNNLLSGAVPSNPNPSASSLQLQLAQLNLSNNLLAGPLPSTLANLTALQTLLASNNRIGGAVPPEVGELRRLVKLDLSGNELSGPIPGAVGQCGELTYLDLSRNNLSGAIPEAIAGVRVLNYLNLSRNALEDAIPTAIGAMSSLTAADFSYNDLSGQLPDTGQLGYMNATAFAGNPRLCGSVVSRPCNYTGGGGVAGAATTRLGGLKLVLALGLLACSVVFAVAAVLRARSFRVDVGAGRWRLTAFHKVDFGVAEVIECMKDGNVVGRGGAGVVYAGRTRSGGAIAVKRLQAQGGAGAQQGDDDRGFRAEVRTLGSIRHRNIVRLLAFCTNREANVLVYEYMGGGSLGVVLHGKGGAFLAWERRYRIALEAARGLCYLHHDCTPMIVHRDVKSNNILLGDNLEARVADFGLAKFLRCGATSESMSAVAGSYGYIAPEYAYTLRVDEKSDVYSYGVVLLELITGRRPVGDFGEGVDIVQWAKRATAGRREAVPGIVDRRLVGGAPADEVAHLFFVSMLCVQDNSVERPTMREVVQMLAELPRHESSPSTSSSSSSSSAVEPPPPQAGEESSPDDGKEPPANCYKLFPDLLA

SEQ ID NO: 28957 - protein, 66 aa, Datura metel
VYILDRAEEEGHDLPYSCRAGSCSSCAGKVTAGTVDQSDGNYLDDDQMAEGFVLTCVAYPQSDVTI

SEQ ID NO: 28958 - protein, 461 aa, Burkholderia xenovorans
MNSAQQQDGLKRGLKNRHIQLIALGGAIGTGLFLGSASVLQAAGPSMILGYAIGGVIAFMIMRQLGEMVAQEPVAGSFSHFAYKYWGDFPGFLSGWNYWVLYVLVSMAELTAVGTYVHYWWPGVPTWVSALVCFAAINAINLANVKAYGETEFWFAIIKVAAVIGMIVFGGYLLISGHGGPQASISNLWAHGGFFPHGFHGLFMMLAVIMFSFGGLELIGITAAEADEPQKSIPKAVNQVIYRILIFYICSLTVLLSLYPWNEVAAGGSPFVMIFSQIGSTLTANVLNVVVLTAALSVYNSGVYANSRMLYGLAEQGNAPRALMKVDRRGVPYMAIGLSALATFTCVIVNYLIPAEALGLLMALVVAALVLNWALISITHLKSRKAMVAAGETLVFKSFWFPVSNWICLAFMALILVILAMTPGLSVSVWLVPAWLVVMWAGYVFKRRRAAVQGGARVVGR

SEQ ID NO: 28959 - protein, 265 aa, Mesorhizobium loti
MTKKPENPGSAGIRVLKTRIKKKSGLKESSRRWLQRHINDPYVQRSKADGYRSRAAYKLIEIDDKHHLLKPGMKVIDLGAAPGGWCQVAAARTKSTAENPHVVGIDYLEMDAVPGAPVLLMDFLDPDAPQKLAEALGGNPDVVLSDMAAPTTGHKRTDHIRTMHLCEVAADFALSVLKPGGHFLAKTFQGGAENELLSMLKKNFRSVHHVKPPASRDESVELYLLAKDFKGREAGPPSGGSERPVDVSKDLSARSDSEGPGDAEG

SEQ ID NO: 28960 - protein, 512 aa, Mycobacterium avium
MTDVVTHTETAPTPAAKAAKPVHTRAVIIGTGFSGLGMAIALQKQGVGFVILEKADDIGGTWRDNSYPGCACDIPSHLYSFSFEPKPDWKNPFSYQPEIWDYLKGVTEKYGLRRYIEFNSLVDRAHWDDDEHRWHVFTTDGREYVAQFLISGAGALHIPSLPDIEGRDEFAGPAFHSAEWDHTVDLTGKRVAVIGTGASAIQIVPEIVGQVAELQLYQRTPPWVVPRSNPEIPPAVRAAMENVPGLRALVRLAIYWGQEALAFGMTKRPNLLKVIEAYAKYNIRRSVKDKELRRKLTPHYRIGCKRILNSSTYYGAVADPKTELVTDHIARITPDGIVTADGTHRPVDVIVYATGFHVTDSYTYVQIKGLHGEDLVDRWNREGIGAHRGITVADVPNLFFLLGPNTGLGHNSVVFMIESQIRYVADAIATCDKLGAQALAPTRAAQDRFNDELQRRLGPSVWNSGGCSSWYLDEHGKNTVLWGGYTWEYWRATRAVKPQEYQFYGIGSRPGV

SEQ ID NO: 28961 - protein, 347 aa, Oryza sativa
MDSTAGSGIAAPAAAAVCDLRMEPKIPEPFVWPNGDARPASAAELDMPVVDVGVLRDGDAEGLRRAAAQVAAACATHGFFQVSGHGVDAALARAALDGASDFFRLPLAEKRRARRVPGTVSGYTSAHADRFASKLPWKETLSFGFHDRAAAPVVADYFSSTLGPDFAPMGRVYQKYCEEMKELSLTIMELLELSLGVERGYYREFFADSSSIMRCNYYPPCPEPERTLGTGPHCDPTALTILLQDDVGGLEVLVDGEWRPVSPVPGAMVINIGDTFMALSNGRYKSCLHRAVVNQRRERRSLAFFLCPREDRVRHYRADTRTLDAFTRWLAPPAADAAATAQVEAAS

SEQ ID NO: 28962 - protein, 201 aa, Prochlorococcus marinus
MSSLRQSEIKRKTNETDISVFINLDGNGISEIETGIPFLDHMLHQISSHGLFDLKIKAIGDTHIDDHHTNEDVGIALGKAFSKALGERKGISRFGHFFAPLDEALVQVTLDCSGRPHLSYDLQLKAPRIGNYDTELVKEFFIAFVNNSGITLHINQIRGSNSHHIVEACFKAFSRAMRMATEIDLRRSDSIPSSKGMLENQ

SEQ ID NO: 28963 - protein, 120 aa, Monotropastrum humile
FLSEACDLVFEAASKEKQFLIIGTNKYIADLVLRYAKKARCHYVNKKWLGGILTNWLTTETRINKLRDLEIEQKMDELKQIIIPKRNDIRLRKQLIHLQAYFGGIKYMTRLPDIVIILDQ

SEQ ID NO: 28964 - protein, 438 aa, Prochlorococcus marinus
MTTSPGVPEPSAQLLRLAAEVRQAAMALGQSDDNQRRKALIAMANALLSSSEQIVRANRLDLEKARTEGLAAALMARLKLDESKLNSAIEGLRQLAQLSDPLGLRQLHRELDQDLVLERITVPLGVLGVIFEARPDAVIQIASLAIRSGNGALLKGGSEASHTNQAIIEALKNGLAETEIDPEAIALLTTRQESLALLRLDGLVDLIIPRGSNELVRFIQDNTRIPVLGHADGICHLYLDAAADLKQALQIAIDSKTQYPAACNAIETLLIHQSIAPSFLELAIPAFRQARVRLLGDSASRALGVEESASEEDWATEYLDLILSVKVVPDLEGALDHIRRYSSRHTEAIVSNDQETAERFLQVVDSAGVFHNCSTRFADGFRYGFGAEVGISTQTLPPRGPVGLEGLVTYRYRLRGQGQIVADYANGECMFTHRDLPL

SEQ ID NO: 28965 - protein, 1034 aa, Photorhabdus luminescens
MKRMLINATQQEELRVALVDGQRLYDLDIESPGHEQKKANIYKGKITRIEPSLEAAFVDYGAERHGFLPIKEIAREYFPNNYHPHGRPNIKDVLREGQEVIVQVDKEERGNKGAALTTFISLAGSYLVLMPNNPRAGGISRRIEGDDRTELKEALASLEVPEGMGLIVRTAGVGKSAEALQWDLSFRLKHWEAIKKAAENRSAPFLIHQESNVIVRAFRDYLRPDIGEILIDNPKVLDLARQHITALGRPDFTSKIKLYSGEVPLFSHYQIESQIESAFQREVRLPSGGAVVIDTTEALTAIDINSSRATRGGDIEETAFNTNLEAADEIARQLRLRDLGGLIVIDFIDMTPVRHQREVENRLRDAVRQDRARIQIGRISRFGLLEMSRQRLSPSLGESSHHVCPRCSGTGTIRDNESLSLSILRLIEEEALKENTHQVHAIVPVQIASYLLNEKRQAVSAIERRQGDVGVVIVPNDQMQTPHFSVLRVRKGEEISALSYLLPQFHEAGAINPQEDVQPERKRPEQPAISAFALPADTPAQQPSHKAKEKKPNHTAQTITEQPGLLSRFLTALKKMFSTEAEEEKPAQKKENKLSGHDNRRSSERRNQRRQNSRKDRDDNNLRDEQRNNRDRDEQRKNRNTQQKNGTQDNNVTIDTAARETQQQQRREQRAERQRRRQEEKRQLQPETQKPEIVENEVEERLPVIPRRQRRQLEQKIRIIDEVKEVTTVASLPIPVVTEEQLPVPVEIPLETAQPQQLTENKEQQDNVMPRRSRRSPRHLRVSGQRRRRYRDERNLLQSPAPLSMAVASPEMASGKVWVRYPVVPISIEMPEEISMIEQQEQQNEVLPVIAAETVPAIIVVAESEQTVIESPKVAETPAAHQNGIKSATGITEQNDIVLQQTKPVQEERSVIELVATTPIIPEFEQQSEADEDIVVSEDVVVSEDIVISKEIAAVMIIEESKDEMVKQPVAIIAKVHHSYAPMTKAPAPEMIEKPIVINEWQRPFSHFEGKGGAGGHSATNAATSPMAKPQFFE

SEQ ID NO: 28966 - protein, 553 aa, Solanum lycopersicum
MGGCFSKKYTQQDANGHRAGRRVNQAYQKPPQPQPERPYQPQPQQERPYQPPPQPAYQPPPQPKPQPQPHPVPVTVQSGQPQDQMQGPHMNNILGKPFEEIRKLYTLGKELGRGQFGVTYYCTENSTGNPYACKSILKRKLVSKNDREDMKREIQIMQHLSGQPNIVEFKGAYEDRQSVHLVMELCAGGELFDRIIARGYYSEKDAAEIIRQIVNVVNICHFMGVMHRDLKPENFLLTSKDENAMLKATDFGLSVFIEEGKVYRDIVGSAYYVAPEVLRRSYGKEADVWSAGVILYILLSGVPPFWAETEKGIFNTILKGEIDFQSDPWPSISNSAKDLIRKMLTQEPRKRITSAQVLEHPWLRLGEASDKPIDSAVLSRMKQFRAMNKLKKLALKVIAENLSEEEIKGLKAMFHNIDTDNSGTITYEELKSGLARLGSKLTETEVKQLMEAADVDGNGSIDYIEFITATMHRHRLERDEHLFKAFQHFDKDHSGFITRDELENAMKEYGMGDEATIKEIIAEVDTDNDGRINYEEFCAMMRSGTTQPQQKLF

SEQ ID NO: 28967 - protein, 173 aa, Pyrola aphylla
FLSEACDLVFDAASRGNQFLIVGTKKKVADLVARAAIRARCHYVNKKWLGGILTNWSTTETRLAKFSGLRIEQTMGSLNRLPKRDAARLKRQLSYLQTNLGGLKYMKRLPDIVIIIDQHKEYKALRECVILGIPTICLIDTNCDPDRIDLPIPANDDNRSSVQFILNKLVFAI

SEQ ID NO: 28968 - protein, 466 aa, Unknown
  Shewanella sp. ANA-3
MSIASVASVFKGEHAVGSTVTVRGWVRTRRDSKAGISFLAVYDGSCFNPIQGVVPNSLENYDNEVLKLTAGCSVIVTGEIVESPGAGQAYELQVTHVEVTGWVEDPDTYPMAAKRHSIEHLRELAHLRPRTNIIGAVARVRNCLSQAIHRFYHENGFVWVSTPLITASDCEGAGEMFRVSTLDMENLPRTSDGKVDYDKDFFGKEAFLTVSGQLNGETYACALSKIYTFGPTFRAENSNTSRHLAEFWMVEPEVAFATLSDIASLAEGMLKYAFNAVLAERMDDLQFFAQHVDKTVIERLQSFVSSDFAQVDYTDAVDILQKCGREFEFPVSWGIDLSSEHERYLAEEHFKAPVVVKNYPKDIKAFYMRLNEDGKTVAAMDVLAPGIGEIIGGSQREERLDVLDMRLEEMDLNKEDYWWYRDLRRYGTVPHSGFGLGFERLVSYVTGVSNIRDVIPFPRAPRTANF

SEQ ID NO: 28969 - protein, 743 aa, Ralstonia eutropha
MNIALQVPDRLLPGKPYPLGAQWDGLGVNFAVFSANASRIDLCLFSANGRKELARMPLPECTDEIWHGYLPNAALGTLYGFRAFGPYDPARGHRFNPHKLLLDPYARRLSGPVRWSDALFGYRLQSARADLTPDRRDSAPTMPKAVVVDESFHWGDDRPPGVPWQDTVIYEAHLRGVSMLRDDVLPHQRGTFAALCDPRFLDHLLRMGITAVELLPIHAILQDRFLLERGLRNYWGYNTLSYFAPEPSYLATDQLHELKVAVRRLHAAGIEVILDVVYNHTCEGNELGPTVSWRGLDNASYYQLVPGDERHYLNDTGCGNMLNLPHPRVLQMVLDSLRYWVQCFHVDGFRFDLGATLGRDHNGFDPGASFFDAILQDPVLSRVKLISEPWDLGPGGYQLGNHPPGFAEWNDKFRDTVRRFWRGDSGQRGELAARLSGSADLFDRRHRRPWASVNFITAHDGFTLADLVSYNGKHNDDNGEENRDGTDNNYSANWSPDGSVEGPTDDPAILALRARVAQAMLSTLLLAQGTPMLTAGDEWGRSQQGNNNAYCQDNAMSWLDWKQAQTPRGQVLLQMVRRLLALRLRLPSLGANHFSHGNQEPAPGIGDIAWFDTEGQPPSPEAWAAPEIRTLALRRAAAPPRSERLELAHRATREGQPGPVNVTLLLLNAGDTDVVFRLPEPALAWQLVLDSSQPQAEAGRPSNAITEQAVPAHSLVLLAAQAAPQRFDHPAEPARAAPQEAAS

SEQ ID NO: 28970 - protein, 240 aa, Thermus thermophilus
MGRVYLVGAGPGDPELLTLKAYRLLKEAPVVLYDRLVDERVLALAPGEKVYVGKEEGESEKQEEIHRLLLRHARAHPFVVRLKGGDPMVFGRGGEEVLFLLRHGVPVEVVPGVTSLLASGLPLTHRGLAHGFAAVSGVLEGGGYPDLRPFARVPTLVVLMGVGRRVWIAKELLRLGRDPREPTLFVERASTPKERRVHARLEEVAEGKVEVRPPALWILGEVVRVFAEKEAPVDALALGG

SEQ ID NO: 28971 - protein, 710 aa, Xanthomonas campestris
MRRPASAAYANPSRIRQGRPFPRGAVFDGKGTNFALFSAHATRVELCLFDEQGNETRVDLPEYTNEIWHGYLPDAKPGQRYGYRVHGPYAPTEGHRFNHNKLLLDPYARELDGDLIWSDELYGYTVGHPDGDLSFDERDSAPFMPKCVVVEDTYDWGDDTRLLKPWNETVIYETHVRGYTMRNPQVPEAVRGTFAGLAQPQVLQYIKDLGITAVELLPVLAYLDDQHLLDKGLRNYWGYNTIGFFALKSRYLSSGHRDEFRDMVKAMHKQGLEVILDVVYNHTAEGSELGPTLSFKGIDNASYYRLADDKRYYINDTGTGNTLNLSNSRVIQFVNDSLRYWAGEMHVDGFRFDLATILGREPSGFDQRGGFLDACNQDPLLSEVKLIAEPWDCGPGGYQVGHFPPGWSEWNDKFRDNAREFWKGEDGKLAEFATRFTGSADLFDRRGRRPWASVNFITAHDGFTLRDLVSYNEKHNIDNGEDNRDGSSNDGSCNYGEEGDTDNAEVLQIRERQMKNLLATLLLSQGTPMMLSGDERAQTQGGNNNTYCQDNEITWLDWENDPTDGRLTEFVKSLTRLRKRYPILSRGRFLNGQYNEEAGLRDLTWLNPGGIEMDDAHWTDPAARSVGLLLEGKAQTSGVKELANDDTLLIVINAYHEGVTFTLPSSDEPVHWKLVLSTDEALEVDMMPAGASEFLAPPRSVSVFECKSDQ

SEQ ID NO: 28972 - protein, 750 aa, Desulfovibrio desulfuricans
MENLFGAKRLTATVGGKEIIMETGRLANQADGAVWIQCGGTVVLCTVCTQPLEREISFFPLVVDYTEKMYAAGRIPGSFFRREIGRPSERETLVSRLIDRPLRPLFPKGFTNEVQILANVISADQENDSDVLALCGSSAAVMLSSVPFEAPVAGARVCRIDGEFVLNPTITEAAKADLNLVVAANRDALVMVEGEADFVPEEVIAQALEWAHREVQPIIDMQEKLRELAGKAKIEFVAPEEDTELKEKAEALATADLAAALQVREKMARKEAKKAVKEKVKAALLQDPAFAETPERLAALGDILSSLEKRIVRQRILKEGLRIDGRDTKTVRPIIIEAGALPRAHGSAIFSRGETKSLVVTTLGSTTDEQRMDSLTGDVTKRFMLHYNFPPYSVGEVKPVRVSRREIGHGALAERALRPVLPSPDSFPFTLRVVSETMESNGSSSMAAVCGGSLSLMDAGVPVKAPVAGIAMGLIKEDDQFIVLTDILGDEDALGDMDFKIAGTAEGVTAVQMDIKIDGLPAEVMGRALAQAREARLHILNEMAKVLPEPRQALSKYAPQLSVVEVNPEIIRVIIGPGGKNIKAITSATGASIDIEDSGRISIFAPTKESMDMAREMVMYYDQRPELGKNYTAKVRKIMEIGAIVEILPNCEALIHISQLDTSRVEKTEDVVQLGQDVEVKVIEINDGRVRASRKAVMLEAQGVEWDPADTARPPRKPRDRDDRGDRGGRGDRGDRGGRNGRGGDRRDRR

SEQ ID NO: 28973 - protein, 407 aa, Thermus thermophilus
MESVSRRTALKLMGLGAALLAAGSRGFAQQAPTADQLVKGKNPKLLVLSQRPIVLETPYDLLVSQPERTPKEILYIRNNVDLPGYNTVEGASLDGWKVEVGGLVDKPFTFEAKELLELPQHEVTMVLQCSGNGRSLFQPRTSGNPWKRGGVGNVTFRGVRLKDLLEAKGVKLGEKALYITAHASRQGNAPEFVRSVPIHALGHALLALSMNGEPLPAVHGGPIRLVFPGYFGVNNVKWVQKIEFTEAENTTAEQMPRYRVPAIPNANIPFLPQEPGKTYPYSFTNSRPNWLVAINSFIFAPLEGQTVEGPYVRVEGVAFNDGIVPLVSVEVSANGGRTWQQARLERQEKSFGWVRWQATLYLRPGEHEVMARAWDAVGRSQPLDGNIAWNERGYEYNGVMRVKFTVA

SEQ ID NO: 28974 - protein, 453 aa, Trichophyton rubrum
MSNLPSEPEFEQAYKELAYTLENSSLFQKHPEYRTALTVASIPERVIQFRVVWEDDNGNVQVNRGYRVQFNSALGPYKGGLRLHPSVNLSILKFLGFEQIFKNALTGLNMGGGKGGADFDPKGKSDNEIRRFCQAFMAELHKHIGADTDVPAGDIGVGGREIGYIFGAYRKAANRFEGVLTGKGLSWGGSLIRPEATGYGLVYYVGHMLEYSGAGSYAGKRVALSGSGNVAQYAALKLIELGATVVSLSDSKGALVATGESGITVEDINAVMAIKEARQSLTSFQHAGHLKWIEGARPWVHVGKVDVVLPCATQNEVSGEEAKVLVANGARFVAEGSNMGCTLDAIELFEAHRNEHKRDQGAVWYAPGKAANAGGVAVSGLEMAQNSQRLTWSAEEVDGKLQAIMKECFETGLRTANEYTEVEDDKLPSLVAGSNIAGFIKVSEAMRDHGDWF

SEQ ID NO: 28975 - protein, 168 aa, Arbutus menziesii
FLSEACDLVFDAASRGNQFLIVGTKKRVADLVARAAIRARCHYVNKKWLGGMLTNWSTTEKRLHKFRDLRMEQKMGRLERLPKRDAARLKRQLSHLQAYLGGIKYMTGLPDIVIILDQHKEYTALRECITLGIPTICLIDTNCDPDLIDLPIPANDDNRSSIRLILNK

SEQ ID NO: 28976 - protein, 469 aa, Oryza sativa
MVLVAIGVVVAAAVVVSSLLLRWNEVRYSRKRGLPPGTMGWPLFGETTEFLKQGPSFMKARRLRYGSVFRTHILGCPTVVCMEAELNRRALASEGRGFVPGYPQSMLDILGRNNIAAVQGPLHRAMRGAMLSLVRPAMIRSSLLPKIDAFMRSHLAAWSSSSSSAVVDIQAKTKEMALLSALRQIAGVSAGPLSDALKAELYTLVLGTISLPINLPGTNYYQGFKARKKLVAMLEQMIAERRSSGQVHDDMLDALLTGVEGTREKLTDEQIIDLIITLIYSGYETMSTTSMMAVKYLSDHPKALEQLRKEHFDIRKGKAPEDAIDWNDFKSMTFTRAVIFETLRLATVVNGLLRKTTQDVEMNGYVIPKGWRIYVYTREINYDPFLYPDPMTFNPWRWLEKNMESHPHFMLFGGGSRMCPGKEVGTVEIATFLHYFVTQYRWEEEGNNTILKFPRVEAPNGLHIRVQDY

SEQ ID NO: 28977 - protein, 345 aa, Bacillus subtilis
MKKVTMLGAGSWGTALALVLTDNGNEVCVWAHRADLIHQINELHENKDYLPNVKLSTSIKGTTDMKEAVSDADVIIVAVPTKAIREVLRQAVPFITKKAVFVHVSKGIEPDSLLRISEIMEIELPSDVRKDIVVLSGPSHAEEVGLRHPTTVTASSKSMRAAEEVQDLFINHNFRVYTNPDIIGVEIGGALKNIIALAAGITDGLGYGDNAKAALITRGLAEIARLGTKMGGNPLTFSGLTGVGDLIVTCTSVHSRNWRAGNLLGKGYKLEDVLEEMGMVVEGVRTTKAAYQLSKKYDVKMPITEALHQVLFNGQKVETAVESLMARGKTHEMEDLVNTFENQVK

SEQ ID NO: 28978 - protein, 352 aa, Borrelia burgdorferi
VKKDYYEILGLSKGASKDEIKKAYRKIAIKYHPDRNQGNEEAASIFKEATQAYEILIDDNKKAKYDRFGHSAFEGGGFEGFSGGFSGFSDIFEDFGDIFDSFFTGNKGQERNRKHAKGEDLGYNIEISLENAYFGYKNNINIARQMLCDSCLGKKSEKGTSPSICNMCNGSGRVVQGGGFFRVTTTCSKCYGEGKIISNPCKSCKGKGSLTKQETIQLNIPPGIDNNQQIKMKGKGNVNPDNQEYGDLYVKILIRSHKVFKRNGKDLYAMLPISFTQAALGKEVKIKTIASKEIKIHIPKGINNEEQILIKNAGMPILQTEKFGNLILITKIKTPKNLNSNAINFLKTWAKN

SEQ ID NO: 28979 - protein, 266 aa, Zea mays
MTTARLVSTSPARLPSTSASPIPRTSLCVVGRAPAFSARALGFSLRLKPSPAMAAAGPPTAHGDSIGSSRIGEVKRVTKETNVHVKINLDGTGVAECSTGIPFLDHMLDQLASHGLFDVYVKAIGDTHIDDHHSNEDIALAIGTALLEALGDRKGINRFGHFTAPLDEAAVEVILDLSGRPHLSCGLDIPTQRVGTYDTQLVEHFFQSVVNTSGMTLHIRQLAGKNSHHIIEASFKAFARALRQATEYDLRRQGTVPSSKGVLSRS

SEQ ID NO: 28980 - protein, 382 aa, Bacillus subtilis
MTEEMNQIDVQVPEVGDVVKGIVTKVEDKHVDVEIINVKQSGIIPISELSSLHVEKASDVVKVDDELDLKVTKVEDDALILSKRAVDADRAWEDLEKKFETKEVFEAEVKDVVKGGLVVDIGVRGFIPASLVEAHFVEDFTDYKGKTLSLLVVELDRDKNRVILSHRAVVESEQANKKQELLQSLEVGSVLDGKVQRLTDFGAFVDIGGIDGLVHISQLSHSHVEKPSDVVEEGQEVKVKVLSVDRDNERISLSIKDTLPGPWNQIGEKVKPGDVLEGTVQRLVSFGAFVEILPGVEGLVHISQISNKHIGTPHEVLEEGQTVKVKVLDVNENEERISLSMRELEETPKADQEDYRQYQAKEETSTGFQLGDLIGDKLNKLK

SEQ ID NO: 28981 - protein, 255 aa, Lactococcus lactis
MSVISMKQLLEAGVHFGHQTRRWNPKMKPYIFTERNGIHVIDLQKTVKLVDDAYNYVKNASQEGAVVLFVGTKKQAAEAVKEEALRAGQYYVNHRWLGGMLTNWNTIQTRVTRLKEINKMEEEGTFEVLPKKEVVLLNKERERLEKFIGGIADMPRIPDVMYIVDPHAEQIAVKEAKTLGIPVVAMVDTNADPEPIDVVIPANDDAIRAVKLITAKMADAIIEGRQGEDAADDFVAEEAASEESLEELAEIVEGK

SEQ ID NO: 28982 - protein, 77 aa, Platanus occidentalis
MKEQKWIHEGLITESLPNGMFRVRLDNEDLILGYVSGKIRRSFIRILPGDRVKIEVSRYDSTRGRIIYRLRSKDSND

SEQ ID NO: 28983 - protein, 291 aa, Saccharomyces cerevisiae
LVHVASVEKGRSYEDFQKVYNAIALKLREDDEYDNYIGYGPVLVRLAWHISGTWDKHDNTGGSYGGTYRFKKEFNDPSNAGLQNGFKFLEPIHKEFPWISSGDLFSLGGVTAVQEMQGPKIPWRCGRVDTPEDTTPDNGRLPDADKDAGYVRTFFQRLNMNDREVVALMGAHALGKTHLKNSGYEGPGGAANNVFTNEFYLNLLNEDWKLEKNDANNEQWDSKSGYMMLPTDYSLIQDPKYLSIVKEYANDQDKFFKDFSKAFEKLLEDGITFPKDAPSPFIFKTLEEQGL

SEQ ID NO: 28984 - protein, 66 aa, Datura arborea
VYILDQAEEEGHELPYSCRAGSCSSCAGKVTAGTVDQSDGNFLDDDQMADGFVLTCVAYPQSDVTI

SEQ ID NO: 28985 - protein, 520 aa, Coprinopsis cinerea
MADTASIPFGRAWWKEAIVYQIYPASFVDSNGDGIGDLNGIASKLDYLKDLGVDVLWLSPIYKSPLADMGYDISDYRDIDPRYGTLEDWDNLLKGVHERGMKLISLMIHTSMIGFKNPARARQTQNETGTFGGLRSSVWEFDEATQEYYLHLYLPQQPDLNWNNPELRDAVWDMMKFWLDRGCDGFRMDVINLISKAEGLPDAPIIAPGEPYQPAGALFANGPHVHKYIQEMNAKVLSKYDIMTVGETPFTHDPSLLAPYVLPRNKELDMVFHFEIIRVDTPRIGNDHIQLAFKPWKLTEFKEIITRWQQYKRDEGFWNATYLENHDHARSVSRFGNDSDQWRMLSAKLLAMLQVMQSGTQYVYQGQELGLKNFPRSWGLEEYKDVATQNYWNKILKQRKAGSDKEVDMEDILDDFAKKARDHARVPMQWDSSPNAGFTAGTPWMRVNEDYRTWNAENQIGDGASILEFWKRLLKLRKSNLTLAPRRFLDIFAVLEILVGQYDSEVGKRYVLERKQELVN

SEQ ID NO: 28986 - protein, 415 aa, Roseovarius nubinhibens
MKVIIAGAGIGGLTTALMLHARGIKAEIYEAAREVREVGVGINVLPHAIRELDALGLLPALDAVGLRTRKLSYLTRDGSEVWSELRGLHAGHDVPQFSIHRGRLQKLIYDAVIDRLGPDAIRTGCRLAGMVQDEAGVTAHFSDNHDGGAGTTVRGDVLICCDGIHSAGRRMFYPKEPGPSWQGVMMWRGAVDWDVWDDGESMAISGGLGGKLVLYPIAPPKDGKQLMNWVVNIRVQDPELSPPPASNWSRQVPLSLVLPYARRFTVPGCDIEALVRATPSIFEYPMADRDPLPRWTFGRVTLLGDAAHPMYPVGSNGASQAILDARCLADALARAEHPRAALWSYEQDRLPKTAEVVRNNRSGGPEGVIDAVERLAPAGFKNIEDVLSYEDREAIVGGYAKLAGFGKVTRVEKTG

SEQ ID NO: 28987 - protein, 176 aa, Picrophilus torridus
MVTKPARMYTRITGPAYTRKEFMGGVPYPKITTFIQGNQKKDFEIEMMLVAEEACQIRHTALEAARVSVNRKLLDAAGSDNYFLQIRPYPHQVIREHKMATGAGADRISSGMRAAFGRPVGTAARVYPGQIIMVGRVDRNNAKLLKDALHKASIKLPTPCKVVVTKGSKITESLGI

SEQ ID NO: 28988 - protein, 393 aa, Treponema denticola
MFLEVPKFLHWEFLVPASKRDYYEVLGVDKKASNDDIKKAYRKLAIKYHPDKNQGDKAAEEKFKEATEAYEILIDEKKRSMYDQFGHAGVDGMSGGGGYDPSAFQGFEDIFGGSFSDIFENLFGGGFSSRSSGFGGRHAGPVRGSNLRYDLQISFVDAVYGKKAELSYTRNEKCSECHGTGSESGSSKRMCPDCKGTGQVRQSTGFFSISRPCPTCGGEGSIIEKPCKKCGGNGLERKKQRIIVTIPAGVENGKRITIPSQGNAGQAGGDYGDLFVFIFVQAHPYFERNGIDLYCAVPISMTQAALGGEINIKSLDEKTLRLKIPAGTQNGKLLRIRGEGVPTGIGRKGDLYIQIQVQIPSKLSSNSKKLLQEISAIEGENENPNLIPLKDLP

SEQ ID NO: 28989 - protein, 478 aa, Prochlorococcus marinus
MNKPRILFWHRKDLRIFDNQALIKAFSLSDAITSTYIFDKNYSHDFNASSRAWFLGNSLQELGNNWKKMGSRLVLEEGDPVLIIPQLAKKIDAKFVFWNRSIEPYEINRDLEIKNNLKEQNIQVIETWDHLLIEPLKIFSGNNNPYSVYGPFYKNLKSKINLLGSFEQDKVVFQFKDIDNKFKENKAINSSDSVLEKFIKNIKFPGSNICPCRPGENAAQTLLENFINEKKIYSYNSARDFPSHNGTSFLSASLRFGTISIRKVWNATLNLNSDFANQENYLSIETWQKELVWREFYQHCLFHFPELEKGPYRKKWDHFPWQNNNELFQHWSNGETGVPIVDAAMRQLNSTGWMHNRCRMIVASFLVKDLICSWQMGEKKFMETLVDGDLAANNGGWQWSASSGMDPKPLRIFNPYTQAKKFDPICEYIKYWIPELSRVSNSELLNGEISNLEKNNYSSPIVNHNIQQRLFKSLYAEI

SEQ ID NO: 28990 - protein, 260 aa, Picea glauca
MEDMNMNIGGAATFYGVNMNEYGDTGVGSMVALMTEQEPGNESIMSTMTMTIPSSAFSSYSHAGQVEGLLSAAAATMFNQGGHHHHQKHLVGGHFPPEQLVMNEQAAVISDSSLSSVKTEVCSNQLEFHRKTSGGGRSCCPQPSLVVRAPQQQQHHHHHQEASRMVTSLEVDIDSACSSNPNDSIDTLKTKIACHPHYPQLLAAYMDCQKIGAPPEVVTVLDEISQENQLGRHLATMDIGVDPELDQFMEAYCQMLIKYH

SEQ ID NO: 28991 - protein, 554 aa, Escherichia coli
MCSIFGVFDIKTDAVELRKKALELSRLMRHRGPDWSGIYASDNAILAHERLSIVDVNAGAQPLYNQQKTHVLAVNGEIYNHQALRAEYGDRYQFQTGSDCEVILALYQEKGPEFLDDLQGMFAFALYDSEKDAYLIGRDHLGIIPLYMGYDEHGQLYVASEMKALVPVCRTIKEFPAGSYLWSQDGEIRSYYHRDWFDYDAVKDNVTDKNELRQALEDSVKSHLMSDVPYGVLLSGGLDSSIISAITKKYAARRVEDQERSEAWWPQLHSFAVGLPGSPDLKAAQEVANHLGTVHHEIHFTVQEGLDAIRDVIYHIETYDVTTIRASTPMYLMSRKIKAMGIKMVLSGEGSDEVFGGYLYFHKAPNAKELHEETVRKLLALHMYDCARANKAMSAWGVEARVPFLDKKFLDVAMRINPQDKMCGNGKMEKHILRECFEAYLPASVAWRQKEQFSDGVGYSWIDTLKEVAAQQVSDQQLETARFRFPYNTPTSKEAYLYREIFEELFPLPSAAECVPGGPSVACSSAKAIEWDEAFKKMDDPSGRAVGVHQSAYK

SEQ ID NO: 28992 - protein, 469 aa, Bacillus licheniformis
MAKQQIGVVGLAVMGKNLALNIESRGFSVSVYNRSSEKTEEFLKEAEGKNVVGTYSIEEFVESLEKPRKILLMVKAGTPTDATIQSLLPHLEKGDILIDGGNTYYKDTQRRNRELAESGIHFIGTGVSGGEEGALKGPSIMPGGQKEAHELVKPILEAISAKVDGEPCTTYIGPDGAGHYVKMVHNGIEYGDMQLISESYFILKHIVGLSSDELHEVFSEWNKGELDSYLIEITADIFTKKDEETGKPLVDVILDKAGQKGTGKWTSQSALDLGVPLPIITESVFARFISSMKEERVKASKLLAGPEAKPAAENKEELIEAVRKALFMSKICSYAQGFAQMKAASEEYGWDLKYGDIAMIFRGGCIIRAAFLQKIKEAYDRDPELDNLLLDPYFKNIVESYQGALRKTISLAVEQGIPVPCFSSALAYFDSYRTATLPANLIQAQRDYFGAHTYERTDKEGIFHTEWMK

SEQ ID NO: 28993 - protein, 540 aa, Unknown
  Shewanella sp. ANA-3
MSELTWWRGAVIYQIYPRSLLDTNGDGVGDLRGIITKLDYIASLNVDAIWISPFFKSPMADFGYDISDYREVDPLFGTMQDFDELIEKAHQRGIKVIIDQVLSHTSDQHAWFCESRESRTNPKADWYVWAEPKEDGTAPNNWLAIFGGCAWEWEPRRQQYYLHNFLRSQPDINFHNPDVRQAVLDNVEFWLKKGVDGFRLDAITFCYHDEQLRDNPPKPKDKRQGRGFSEDNPYAYQYHYYNNDRPQTILFIEELRQLINRYPGAVTLGEVSAEDSLAVMAAYTKGEDRLHMAYSFELLTDDYSAAYIRQTVEALEASIGDGWPCWAIGNHDAQRVASRWGRGKQTSDMVKMLNAMVNSLRGSVCSYQGEELGLTEAPIEYHELQDPFGKTFWPMFKGRDGCRTPMPWEQNADFSGFSQVTPWLPIAQAHRALAVDVQEADSQSMLHGYRQFLAWRKGYPALVEGEIEFLDAPEPLLVFVRTSGEQKLLVCFNLQDTEQALSLDALSIQQEITGHGLKTAQRIADTLTFSAYACFYALLN

SEQ ID NO: 28994 - protein, 173 aa, Arctostaphylos manzanita
FLSEACDLVFDAASRGNQFLIVGTKKRVADLVARAAIRARCHYVNKKWLGGMLTNWSTTEKRLHKFRDLRMEQKMGRLERLPKRDAARLKRQLSHLQAYLGGIKYMTGLPDIVIILDQHKEYTALRECITLGIPTICLIDTNCDPDLIDLPIPANDDNRSSIRLILNKLVFAI

SEQ ID NO: 28995 - protein, 612 aa, Gibberella zeae
MLRPQANRARDLVSLDGVWNFALAKSHDIETEQAWKKRISPELQVPVPASYNDIFADETIRDHVGWVYYQRQAVVPRGWVAPQRVFLRVDAATHHGRVYVNDKFVVEHIGGYTPFEIELTGLVEPGSEFRLTIAVNNQLTWETIPPGRIEAQSDGSRKQSYQHDFFNYAGLARSVWLYSVPKVFINDISVGTDLLGDGTGIVEFDIRTSGELQADARWRILLDDEEDATVCQAQESHGKLEVKNAKYWAPGAAYLYQLRAQLVRGEHDEILDTYNLAVGIRSVEIRDGRFFINGKPFYFTGFGKHEDGPVRGRGYDASYMIHDYRLMKWIGANSFRTSHYPYAEEVLEYADRHGVVVINETAAVGLNLNIVSGMFGNKQLATFSPDTMSSKTQASHEQAIRELISRDKNHPCVVMWMLANEPGASEQGSREYFEPLVTLARSLDSQKRPMCYSHMIHSKPDTDRIADLFDVVCMNRYYGWYTQTGNLKAAEVALEAELRSWQEAYAAKPIIMTEYGTDTVAGLHTVCDVPWTEEYQVRFLDMYHRVFDRIDNVVGEHVWNFADFQTSAMIIRVDGNKKGIFTRDRRPKSAAHALRARWTGPVGPRKIEVTKQ

SEQ ID NO: 28996 - protein, 173 aa, Arctostaphylos uva-ursi
FLSEACDLVFDAASRGNQFLIVGTKKRVADSVARAAIRARCHYVNKKWLGGMLTNWSTTEKRLHKFRDLRMEQKMGRLERLPKRDAARLKRQLSHLQAYLGGIKYMTGLPDIVIILDQHKEYTALRECITLGIPTICLIDTNCDPDLIDLPIPANDDNRSSIRLILNKLVFAI

SEQ ID NO: 28997 - protein, 713 aa, Rhodospirillum rubrum
MEKVLTVCPYCGSGCKINLLVENDQVIGAEPAQGVTNQGELCLKGYYGWDFLNDPKLLTPRLRKPLIRRTRDSAFEEVSWYEAINFAATRLQEIKHKYGPDSIMLTGSARGPGNEANYVMQKFARAVVGTNNIDHCARVCHGPSVAGLQVTLGNGAMSNSVEEIENTKCVFVFGYNAAVSHPIVARRILKAKEKGAKIIVCDPRFIETARIADLWLPLKNGTNMALVNAFAHVLLEENLYDKDFVAKYTEGLDDYKATVAKYTPEYAEKITGVPAQQIREAMRMYAGAETATVMWGMGVTQWSQAVDVVKGLSGLALLTGNLGKPSCGVAPVRGQNNVQGACDHGALPNMLPGYQPVTDAAARAKFEKAWGVSNLPDKPGVCLTEVPKMVKAGKLKAYYIFGEDPAQTDPDLHEVRESMRDLEFVICQEIFMTKTAMMADVVFPATSWGEHEGVYSSCDRGFQRFYKAIEPQGDVKPDWEIISLMATAMGYPMKYSNTQEIWDELRELCPIYYGATYEKMAGLGYIQWPCPDLDHPGTPYLYADKKFQTPSGKGLLFACEWRPPMEKVDAAYPLILSTVREVGHYSCRTMTGNCHALQTLADEPGYISMHSKDAKALGISDQHLVSISSRRGKIIARADIDDRINEGAVYMTYQWWVGACNELTAEHLDPISKTPEYKYSAVKVEAIADQAWAENHVQEVYSQLKADLANAVA

SEQ ID NO: 28998 - protein, 412 aa, Lactobacillus plantarum
MNYQEQDPEVWAAISKEQARQQHNIELIASENIVSKGVRAAQGSVLTNKYSEGYPGHRFYGGNEYIDQVETLAIERAKKLFGAEYANVQPHSGSQANAAAYMALIQPGDRVMGMSLDAGGHLTHGSSVNFSGKLYDFQGYGLDPETAELNYDAILAQAQDFQPKLIVAGASAYSRLIDFKKFREIADQVGALLMVDMAHIAGLVAAGLHPNPVPYADVVTTTTHKTLRGPRGGMILAKEKYGKKINSAVFPGNQGGPLDHVIAGKAIALGEDLQPEFKVYAQHIIDNAKAMAKVFNDSDLVRVISGGTDNHLMTIDVTKSGLNGRQVQDLLDTVYITVNKEAIPNETLGAFKTSGIRLGTPAITTRGFDEADATKVAELILQALQAPTDQANLDDVKQQAMALTAKHPIDVD

SEQ ID NO: 28999 - protein, 174 aa, Comarostaphylis arbutoides
FLSEACDLVFDAASRGNQFLIVGTKKRVADSVARAAIRARCHYVNKKWLGGMLTNWSTTEKRLHKFRDLRMEQKMGRLERLPKRDAARLKRQLSHLQAYLGGIKYMTGLPDIVIILDQHKEYTALRECITLGIPTICLIDTNCDPDLIDLPIPANDDNRSSIRLILNKLVFAIC

SEQ ID NO: 29000 - protein, 174 aa, Gaultheria shallon
FLSEACDLFFDAASSGKQFLIVGTKERVADSVARAAIRARCHYVNKKWLGGLLTNWSTTERRLRKFRNLRRMEQKMGRRNRLLKRNAARLKRKLSHLQVYLGGIKYMTGLPDIVIIIDQHKEYTALRECIILGIPTVGLIDTNCDPDLVDFPIPANDDTRASIQFILSKLVFAI

SEQ ID NO: 29001 - protein, 428 aa, Nostoc punctiforme
MSDENLFDQEDYLQARVDECIWQKSTDAGISRQRFLKILATMVGATAIGGLAKPAPAHSQAAVKTKGSKILKPLPPGYISHSKGTLEMNWEAMYERGYLVPNDWFYVHNRSTPPPFDPSIWRLQIHGTGVSVPCEFTYDEIITMPSISVTCAIECAANGRRFFEEAYNTPLSGTRWRLGAIGVAEWTGVPLSILLERAGLKSTAKDVLVEGADVDSLDSKGTNKSKFSSVVPISKALADNSLVVYAMNGEPLPPDHGQPCRVLFPGWGGNANVKWIERIEVSETPIYTQWVTEQMVLVGADYPAIAPYKGKLITYQNVKSAFELAWPATLSARTHLLRGRSWSGKGKIARVEVSLDGGKTWQLARLREPNFPFAWTRWDIEWNPVPGEYFLQARATDNLGNTQPNTVPWNDFGLLYGGIVSHPVTVRG

SEQ ID NO: 29002 - protein, 291 aa, Saccharomyces cerevisiae
LVHVASVEKGRSYEDFQKVYNAIALKLREDDEYDNAIGYGPVLVRLAWHISGTWDKHDNTGGSYGGTYRFKKEFNDPSNAGLQNGFKFLEPIHKEFPWISSGDLFSLGGVTAVQEMQGPKIPWRCGRVDTPEDTTPDNGRLPDADKDAGYVRTFFQRLNMNDREVVALMGAHALGKTHLKNSGYEGPWGAANNVFTNEFYLNLLNEDWKLEKNDANNEQWDSKSGYMMLPTDYSLIQDPKYLSIVKEYANDQDKFFKDFSKAFEKLLEDGITFPKDAPSPFIFKTLEEQGL

SEQ ID NO: 29003 - protein, 150 aa, Glycine max
TKEDILSLPCFQNQEIIAIKAPKASCIEVPDPDEELGFRQRQYKMIVRSAIGPINLYLLSKDDSKFEDDSAKRMKLMDPSWNSDPIRKRGVGLLESQHDEKNPSEHFSLQGSQAFGIQEITPTDFEMEDDYWFQSDPGVSQTELWGSNIF

SEQ ID NO: 29004 - protein, 493 aa, Photorhabdus luminescens
MSQQQKSVSRKPATQHLRRELKARHLAMIAIGGSIGTGLFVASGATVSQAGPGGALLSYALIGLMVYFLMTSLGELAAYMPVSGSFSTYGSKYVEEGFGFALGWNYWYNWAVTIAVDLVAAQLVMGYWLPDMPGWIWSALFLALIFLLNFISVKGFGEAEYWFSLIKVSTVIVFIVVGLLMIAGIMKGAEGAGWHNWTVGDAPFAGGFSAMIGVAMIVGFSFQGTELIGIAAGESKDPAKNVPSAVRKVFWRILLFYIFAILIISLIIPYTDPSLLRNEVGDISVSPFTLVFENAGLLSAAAMMNAVILTAVLSAGNSGMYASTRMLFTLAKEGKAPRIFGKLSKGGVPRNALYATTVVAALCFLSSMYGNQTVYLWLLNTSGMTGFIAWLGIAISHYRFRRGYVAQGLDLSKLPYRSGFFPVGPIFAFVLCLTITLGQNYQAFLQDKIDWYGVTATYVGIPLFLLIWFGYKLARKTHFIKYSEMKFPDIENQ

SEQ ID NO: 29005 - protein, 338 aa, Ralstonia eutropha
MKKISDRIASFSRLQLVGAVTPLEKLDRLSRMLGRDVYIKRDDTTPLAFGGNKLRKLEFLAADALSKGADTLVTAGAIQSNHVRQTAAVAARLGLRCHALLENPINTTDVDYLRSGNRLLLDLFDAHGEPVATLDNADAQLQALAERLRGDGYQPYIIPIGGSNPLGALGYVHAGLEMAQQADAMGVSFAAVVLASGSAGTHGGLALALAHAMPDAQVVGITVSRPVEAQAPKVAGLIDGTAELLDIEVPAELRLELWDEYFLPRYGEPNRAALDAIRLLARTEGVLLDPVYTGKAMAGLLDGVMRKRFAGEGPLLFLHTGGAPALFAYRDALPAVLI

SEQ ID NO: 29006 - protein, 330 aa, Desulfovibrio desulfuricans
MKIAVAGGGSWGSALAHLLAANACDVTLLVRDAVQARRINADHVNPDYLPDVVLHSSVRATVDDAEALDGAGLLLMAVPCQHFRKVLQRLRPLLPPEPVVVCANKGIEVENLCTVSEVVAQELEGTGHTFAMLSGPSFAVEVMRDMPTAVVLGCRDAATGRRLRHIFSYGLFRTYSSTDVRGVELGGAVKNVIAIAAGLADGLGFGHNARAALITRGLAEMSRLGVAMGARASTFMGLSGMGDLVLTCTGDLSRNRQVGLKLAQGMTLEEVTRSMRMVAEGVKTTEAVHTLAARLQVDLPITSAMYDVLHSGKNPRDAVRELMSRELKEE

SEQ ID NO: 29007 - protein, 167 aa, Gaultheria macrostigma
FLSEACDLFFDAASSGKQFLIVGTKERVADSVARAAIRARCHYVNKKWLGGLLTNWSTTERRLRKFRKLRRMEQKMGRRNRLLKRNAARLKRKLSHLQVYLGGIKYMTGLPDIVIIIDQHKEYTALRECIILGIPTVGLIDTNCDPDLVDFPIPANDDTRASIQFIL

SEQ ID NO: 29008 - protein, 504 aa, Unknown
  Synechococcus sp. RS9917
MAVADQPLQLVWFKRDLRSVDHRPLALALERGPVLPLYIVEPQFWLQPDASARQWAFCREALEALQERLSALGQPLVVRVGDAVEVLERARLRLGVAALWSHEETGNAFTYARDRRVKAWARSHGIPWRECPQFGVIRGLRRREGWATRWQERMATPLTPEPLALPPLPAIQPGGLPSASDLGLTADPCPCRQRGGRPQAETVLQDFLQRRVQRYCGSISSPLTAFDGCSRLSPYLTWGCLSLREVVQASASLTCRGVRNFRSRLHWHCHFIQKLESEPAIEHRDFHPFMRDIRVWDAERYQAWAEGRTGLPFVDACMRALIAHGWINFRMRAMLMSVATYHLWLPWRDTGLHLARLFVDYEPGIHWSQCQMQSGSTSINTIRIYNPIKQGLDHDPKGVFIRRWCPELAHRPDVWLHEPWRGGGDHPAPIVDPDQAAREARDRIWAIRRAAGFDRIADAIQERHGSRRAGLTPTGGRGSRRRRRTDIADASMRQLSLQVEIDPA

SEQ ID NO: 29009 - protein, 291 aa, Saccharomyces cerevisiae
LVHVASVEKGRSYEDFQKVYNAIALKLREDDEYDNYIGYGPVLVRLAWHISGTWDKHDNTGGSYGGTYRFKKEFNDPSNAGLQNGFKFLEPIHKEFPWISSGDLFSLGGVTAVQEMQGPKIPWRCGRVDTPEDTTPDNGRLPDADKDAGYVRTFFQRLNMNDREVVALMGAHALGKTHLKNSGYEGPQGAANNVFTNEFYLNLLNEDWKLEKNDANNEQWDSKSGYMMLPTDYSLIQDPKYLSIVKEYANDQDKFFKDFSKAFEKLLEDGITFPKDAPSPFIFKTLEEQGL

SEQ ID NO: 29010 - protein, 291 aa, Saccharomyces cerevisiae
LVHVASVEKGRSYEDFQKVYNAIALKLREDDEYDNYIGYGPVLVRLAWHISGTWDKHDNTGGSYGGTYRFKKEFNDPSNAGLQNGFKFLEPIHKEFPWISSGDLFSLGGVTAVQEMQGPKIPWRCGRVDTPEDTTPDNGRLPDADKDAGYVRTFFQRLNMNDREVVALMGAHALGKTHLKNSGYEGPWGAANNVFTNEFYLNLLNEDWKLEKNDANNEQWDSKSGYMMLPTDYSLIQDPKYLSIVKEYANDQDKFFKDFSKAFEKLLEDGITFPKDAPSPFIFKTLEEQGL

SEQ ID NO: 29011 - protein, 285 aa, Xanthomonas campestris
MSTNDNWYIEHFQPTGSAIGFRISGKLDEVQSPFQKIEIYQTTDWGKLMLIDGAVMLTSRDNFFYHEMISHPALFTHPAPKRVVIIGGGDCGTLREVLKHPGVESATQCDIDEQVTRMSEKYFPELCDANHDARAELLFDDGVAYMANCPAGSVDIVIVDSTDPVGPAEGLFNKAFYESCFKALKDEGILVQQSESPLALLDLINEMRTEMGKAGFQSFKTLPFPQPCYPTGWWSVTMASKQANADFAFRQADAQAKGFDTLYYTAHLHTGVLVAPPFVAKALGE

SEQ ID NO: 29012 - protein, 291 aa, Saccharomyces cerevisiae
LVHVASVEKGRSYEDFQKVYNAIALKLREDDEYDNYIGYGPVLVRLAWHISGTWDKHDNTGGSYGGTYRFKKEFNDPSNAGLQNGFKFLEPIHKEFPWISSGDLFSLGGVTAVQEMQGPKIPWRCGRVDTPEDTTPDNGRLPDADKDAGYVRTFFQRLNMNDREVVALMGAHALGKTHLKNSGYEGPYGAANNVFTNEFYLNLLNEDWKLEKNDANNEQWDSKSGYMMLPTDYSLIQDPKYLSIVKEYANDQDKFFKDFSKAFEKLLEDGITFPKDAPSPFIFKTLEEQGL

SEQ ID NO: 29013 - protein, 426 aa, Bacillus subtilis
MAADRNTGHTEEDKLDVLKSTQTVIHKALEKLGYPEEVYELLKEPMRLLTVKIPVRMDDGSVKIFTGYRAHNDSVGPTKGGIRFHPNVTEKEVKAVKALSIWMSLKCGIIDLPYGGGKGGIVCDPRDMSFRELERLSRGYVRAISQIVGPTKDVPAPDVFTNSQIMAWMMDEYSRIDEFNSPGFITGKPLVLGGSHGRESATAKGVTICIKEAAKKRGIDIKGARVVVQGFGNAGSYLAKFMHDAGAKVVGISDAYGGLYDPEGLDIDYLLDRRDSFGTVTKLFNDTITNQELLELDCDILVPAAIENQITEENAHNIRAKIVVEAANGPTTLEGTKILSDRDILLVPDVLASAGGVTVSYFEWVQNNQGFYWSEEEVEEKLEKMMVKSFNNIYEMANNRRIDMRLAAYMVGVRKMAEASRFRGWI

SEQ ID NO: 29014 - protein, 301 aa, Oenococcus oeni
MKVGMIGLGKMGLNLVKNMIDNKIEVVGFDLNSDSIDKAASYGAQTAVDTQDLVDKLDSPRIVWVMVPAGKPTNSTIDDLIEKLDAGNILIDGGNSNYKDNLEQNKRTTAAGIKFFDAGTSGGMEGALEGGNFMVGGDDPEAWKTIEPLFKAISVKDGYLYTGKLGSGHYLKMVHNGIEYGEMQAIAEGFEVLEGSQFDYDYEAVAKLWNHGSVIRGWLMELAEDAFSKDPKLDQIAGRMHSSGEGKWTLEEAMNMRIPTPVIALSLMMRYRSMQDDTFTGKVVAALRHEFGGHAVDKCDN

SEQ ID NO: 29015 - protein, 576 aa, Brucella melitensis
MAIPDAPGVYMSQSNPTRADFESLLAESFAEHDLAEGYVVKGRIVAIEKDMAIIDAGLKVEGRVPLKEFGAKGKDGTLKPGDEVEVYVERIENALGEAVLSREKARREESWVKLEQKFANGERVDGVIFNQVKGGFTVDLDGAVAFLPRSQVDIRPIRDVTPLMHVPQPFEILKMDKRRGNIVVSRRTVLEESRAEQRSEIVQNLEEGQVVEGVVKNITDYGAFVDLGGIDGLLHVTDMAWRRVNHPSEILTIGQTVKVQIIRINQETHRISLGMKQLESDPWDGIGAKYPIGKKITGTVTNITDYGAFVEIEPGIEGLIHVSEMSWTKKNVHPGKILSTTQEVEVVVLEVDPVKRRISLGLKQTLDNPWTTFAQKYPVGTVVEGEVKNKTEFGLFIGLDGDVDGMVHLSDLDWNRPGEQVIEEYNKGEVVKAVVLDVDVEKERISLGIKQLSGDKVGEAAASGELRKNAVVTCEVTAVTDGGLEVRLVDHDLDSFIRRSDLSRDRDEQRPERFTVGQKVDARVIAFDKKTRKLQVSIKALEIAEEKEAVAQYGSSDSGASLGDILGAALKKQEKN

SEQ ID NO: 29016 - protein, 838 aa, Coprinopsis cinerea
MAYTPSDFDGNQDEYAPPEHHVIEPDMRGMEEALGFSVSAFARSRSRAATPTEAGPSTVKQQPFSPAIAADKKGKQRAERQMDVAGAFTQNAEAQRSKKEKKKVKKKRQSVVPVVKLSGFGSKDDPFTLDDSDDDAGKASATAPVGGVSWAESNLNPPSTVTATATAPLPPLPVRPPAPPPTLVATSSTTATTGTARANATAILSDPHVAGGTKAPALEPAVSTSTAIGSSVKDASKGSKLKELLEQERSRVAASTPVPIPRPASQAPVTPSIASVPLAPTSNPTVSPDKSFTETRGGESRGSSEEQESRDTSAKSTPSSAVVLPSSATKAVPVLGTSMTTAVGVHSREEGMEDEDDDLPTLPLTGPEEVGTSDENAAMEVDDLLVPSRQSSAEIEDITVALGSQDIANGEPSRQPSSDEDEGSPSTPEDQDNSEFDVANDEDDDDELALVPGQPPPPLESKTARIEKFKAAAVTTPARTGASGFQQLTFHDYRLHLQNTPFEVYYARDLPHSLQDGINNTKDMHLLAGMRDLFKAFIQEHTVQDEPDAPPIDIINNIDDEPAPPWEFHYSNQMWHSDNVPPPDVKNLEGCDCVGRCTKSCACLRRQKKLLDPEGPPGQVNDFMYDKKGRLRHPEFQEPIVECNALCGCDQDCVNRVVQNGRKVQVSIQKTKHKGWGVFAGPKKIPKGTFLGVYSGELLTDEEGDERGKVYNKFGRTYLFNLDFWFLKANLTPEEAEEWDNKYVVDAFNVGNFTRFLNHSCDPNCKIHPCFINEANKEKPLLTVFTDRDIDPYEEICFNYTGMDADEAKARVSEMAKTDKIYEPCMCGAKNCCGVMFE

SEQ ID NO: 29017 - protein, 399 aa, Sinorhizobium meliloti
MTEMLTMKRRSFLTGSAGAVVAAGTGGLAEAKETKPLPDYVAWKDADALIVHSDKTLETKRSEFGTSIITPEEKLYIRNNVNTPPESILADRDGWKVEISGVKEPRTLTVAELKTLGLVTAATVLQCSGNGRKYFKDQLTGDQKMSGTPWTVGAAGCVIWSGVPLKAVVDALGGPAEGARFITGTGGEELPAGLDPKLLVVERSVPISNLDNVILAWEMNGRPLSLAHGGPLRMVVPGYSGVNNIKYVKAVAMTEVETDAKIQKTSYRVHALGEKGSPDQPSVWEQPVKSWITTPHEAAKAGQVQIAGVAFGGMNACKSVEVSVDGGQTWQEAEFIGPDLGRFAWRVFALSADLARGTYTLVSRATDTEGNVQPEETEMNGAGYGHNGWRAPAVKLTVA

SEQ ID NO: 29018 - protein, 107 aa, Aggregatibacter actinomycetemcomitans
MSEVLHSSDATFVADVLNSEVPVLLDFWATWCGPCKMIAPILDDLAVEFDGKVKIVKINIDDNQATPAQFGVRSVPTLLLFKDGKPVATQVGALPKNQLAAFINQNI

SEQ ID NO: 29019 - protein, 294 aa, Oryza sativa
MSGELKRDYEIGEEIGRGRFGVVHRCTSRATGEAFAVKSVDRSQLADDLDRELAELEPKLAQLAAAGNPGVVQVHAVYEDDAWTHMVMDLCSGPDLLDWIRLRRGAPVPEPVAAAVVAQLAEALAHCHRRGVAHRDVKPDNILLDVVDDGIDGGGTPRARLADFGSAAWVGESGGSAEGLVGTPHYVAPEVVAGGEYGEKADVWSAGVVLYVLLSGGALPFGGETAAEVLASVLRGSVRFPPRLFAGVSPAAKDLMRRMMCRDTWRRFSAEQVLGSKMLSLFARSVLSPGHVLE

SEQ ID NO: 29020 - protein, 417 aa, Pseudomonas fluorescens
MFSKQDQIQGYDDALLAAMNAEEQRQEDHIELIASENYTSKRVMQAQGSGLTNKYAEGYPGKRYYGGCEHVDKVEALAIERAKQLFGADYANVQPHSGSSANSAVYLALLQAGDTILGMSLAHGGHLTHGAKVSSSGKLYNAVQYGIDTKTGLIDYDEVERLAVECKPKMIVAGFSAYSKTLDFPRFRQIADKVGALLFVDMAHVAGLVAAGLYPNPLPYADVVTTTTHKTLRGPRGGLILAKANEEIEKKLNAAVFPGAQGGPLMHVIAGKAVCFKEALEPGFKAYQQQVIDNAQAMASVFIKRGYDVVSGGTDNHLFLVSLIRQGLTGKDADAALGRAHITVNKNAVPNDPQSPFVTSGLRIGTPAVTTRGFKVTQCVTLAGWICDILDNLGDADVEANVAQQVSALCADFPVYR

SEQ ID NO: 29021 - protein, 658 aa, Pediococcus pentosaceus
MSIVFFVLILIIATVFSNALDTKIKFLPRAIIQIMMGLALSFIPNFNHFNLNPEVFMLAIIAPLMFYDGMNTNIVKLKRTLSNTFSLAIGLAVVTIILVGYLGYALLPHIPIALAFALAAIITPTDAVAVSSVTENLDLPNEAMLSLKNESLFNDASGIVMFDLALTAFHTGHFSPVLSIFNYLYVFFGGLIVGWIVGWLFVRLQLLLIETDIDNPNIIVPINFIKPFAIYLLAEMFDTSGILAVVAAGLIQSTQAQSLRLTSTKTQMVSKTTYEIFTNLMNGFVFILLGVSFPTVIYDITNEGRQVSSLGYLILVGIILYIVMIIIRYLWVTLKLANIRIRPADKVLNHFLIAINGIHGTITLSMAFSIPIVLHGKIFPFRNDIIFIAATVIILSLLVPSIILPLMLPAKSYSYSLEDISTYRQKMIEYAIKRVHDADEDPVETQAVIATLRSQQSILQRPKRNATYKILQKCFNLEEKLLQEMVDNGEISVKQQTFYERMSLFQSFQLHQSFIQHFMYRARFYFIKLSHRFKRRIKRVDPLVVTKKFNNARDELAQVENEISPQIFAYLKEHLNADNRAEIHWIEEYYRERHRRFQNNTRANEIQEELFINAFQNEYNFIQEQLGKKNISRELASLLYEQVSNDEWVYMQNDSIYA

SEQ ID NO: 29022 - protein, 239 aa, Francisella tularensis
MSLMKEMLSAGVHFGHKKAFWNPQMKEYIFGINHGVHIINLEKTVPLFQDAVNFVGKTVANGGKILFVGTKRQAQDIVEAEAKRCGMPFVSHRWLGGMLTNYKTVRQSIKRLAQLEKMREDGTLESLTKKEMLQNIRTIEKLEKVLGGIKEMGGLPDAIVVIDGNKEHIAIQEAQKLGIKVVAIVDTNSNPEGIDYIIPGNDDAVKSISFYMKKFADAVIDAQGLDRAVEAKADEAAQA

SEQ ID NO: 29023 - protein, 1173 aa, Burkholderia xenovorans
MECNLHGRTASHATRRRKASMHQTQPQTPPPAAAATQAGASRPPAGGTQRIVKIRRDYNAWVGDETLEDYALRFTPRAFRRWSEFRVANTAIGAVSFLVLEAIGGALVVNYGFTNAICAILAVSLLIFLTGIPISYYAARNGVDMDLLTRGAGFGYLGSTLTSLIYAVFTFVFFALEAAIMSLALELYLKVPLSVAYVISALVIIPVVTFGITFINRLQGWTQPLWLVLLVVPYVVVLWREPHVLAEWVTFSGVSGNGHEFNLVAFGAGCTVVFSLIVQIGEQVDYLRFLPPRTRANRFRWWAALIAAGPGWIVPGAMKMLGGAFLAFLAIQHEIDPVKAVEPTQMYLVAYHYVFHSPEGALAAMTLFVIVSQLKINVTNAYAGSLAWSNFFARLTHSHPGRVVWLVFNVLIALLLVEMGVFEAISKVLALYANVAIAWIGAVVGDLVINKPLGYSPRHVEFKRAHLYDVNPVGVGAMLIASLIAALSHAGVFGTTAEALSSFIALLVAFVCAPLLAIATRGRFYLARDGRDLEEGAILRCVICENTFEREDMAHCPAYAGSICSLCCSLDSRCNDSCKPHARLPAQFGKSMRTLFPRLTLGPAGLRLAQYAGLLIAVVTLLGGVLAVQWYQSVRTLPNLDTTVHDVLLQGYLKAFFALALVGCIAAWWLVLANENRKVTQEESQRQAELLMQEIEAHRKTDAALQRASAAAESANRAKSRYVTGLSHELRTPLNSILGYAQLLLQGTDELPPARRNAVATIYRSGEHLLALVDGLLDVARIEAGKLQLNVTEISLPDFVAQLAAMLEPQATDKGLQFEFQTSGRMADVVRIDEKRVRQILINLIGNAIRFTSHGSVKVRASYAWEAITFEITDTGPGMPASELERLFLPFERGAAAREHDHGAGLGLTICRLLTELMGGNLEVQSEVGKGTRFIVKLFAPEVRAPQLLASGPLNVKGYDGPRRTVLVVDDLAEQRRIVVQTLAPLGFNVVEAASGPEALQWLGTASADLIVMDVSMPDMDGFEASRLIRDNHLSAAPVLILSANAFADDRDKGAAAGCDDYLAKPLYIPLLLDKLAALLQLHWIVEPTEAAAASAVARVDVTASLPATLREKLRAQLEMGYVQGFIEQLDAAEHGAPELAAVLEPLRALARRFRLTELAHLLAPTPQVHPDA

SEQ ID NO: 29024 - protein, 295 aa, Unknown
  Nostoc sp. PCC 7119
DVPVNLYRPNAPFIGKVISNEPLVKEGGIGIVQHIKFDLTGGNLKYIEGQSIGIIPPGVDKNGKPEKLRDYSIASTRHGDDVDDKTISLCVRQLEYKHPESGETVYGVCSTYLTHIEPGSEVKITGPVGKEMLLPDDPEANVIMLATGTGIAPMRTYLWRMFKDAERAANPEYQFKGFSWLVFGVPTTPNILYKEELEEIQQKYPDNFRLTYAISREQKNPQGGRMYIQDRVAEHADQLWQLIKNQKTHTYICGLRGMEEGIDAALSAAAAKEGVTWSDYQKDLKKAGRWHVETY

SEQ ID NO: 29025 - protein, 603 aa, Escherichia coli
MLRPVETPTREIKKLDGLWAFSLDRENCGIDQRWWESALQESRAIAVPGSFNDQFADADIRNYVGNVWYQREVFIPKGWAGQRIVLRFDAVTHYGKVWVNNQEVMEHQGGYTPFEADVTPYVIAGKSVRITVCVNNELNWQTIPPGMVITDENGKKKQSYFHDFFNYAGIHRSVMLYTTPNTWVDDITVVTHVAQDCNHASVDWQVGANGDVSVELRDADQQVVATGQGTSGTLQVVNPHLWQPGEGYLYELCVTAKSQTECDIYLLRVGIRSVAVKGEQFLINHKPFYFTGFGRHEDADLRGKGFDNVLMVHDHALMDWIGANSYRTSHYPYAEEMLDWADEHGIVVIDETAAVGFNLSLGIGFEAGNKPKELYSEEAVNGETQQAHLQAIKELIARDKNHPSVVMWSIANEPDTRPQGAREYFAPLAEATRKLDPTRPITCVNVMFCDAHTDTISDLFDVLCLNRYYGWYVQSGDLETAEKVLEKELLAWQEKLHQPIIITEYGVDTLAGLHSMYTDMWSEEYQCAWLDMYHRVFDRVSAVVGEQVWNFADFATSQGILRVGGNKKGIFTRDRKPKSAAFLLQKRWTGMNFGEKPQQGGKQ

SEQ ID NO: 29026 - protein, 295 aa, Unknown
  Nostoc sp. PCC 7119
DVPVNLYRPNAPFIGKVISNEPLVKEGGIGIVQHIKFDLTGGNLKYIEGQSIGIIPPGVDKNGKPEKDRDYSIASTRHGDDVDDKTISLCVRQLEYKHPESGETVYGVCSTYLTHIEPGSEVKITGPVGKEMLLPDDPEANVIMLATGTGIAPMRTYLWRMFKDAERAANPEYQFKGFSWLVFGVPTTPNILYKEELEEIQQKYPDNFRLTYAISREQKNPQGGRMYIQDRVAEHADQLWQLIKNQKTHTYICGLRGMEEGIDAALSAAAAKEGVTWSDYQKDLKKAGRWHVETY

SEQ ID NO: 29027 - protein, 405 aa, Vibrio vulnificus
MAGVLGMILAGGEGSRLRPLTESRSKPAVPFGGSYRLIDFALNNFVNADLMRIYVLTQFKSQSLFHHMKKGWNINGITDRFIDPIPAQMRTGKRWYEGTADAIYQNLRFMELSEPEQVCIFGSDHIYKMDIKQMLSFHKEKLAALTVSALRMPLAEASQFGVIEVDAEGRMVGFEEKPSAPKSIPGDPDFALVSMGNYIFEADVLFAELIEDADNENSSHDFGKDIIPKMFPRGDVFVYDFSQNRISGEKAEVYWRDVGTIDAYWQAHMDLLKTDAPFSLYNRKWPLHTYQPPLPPATFTDSDNGRVQIIDSLVCNGSYVRGSRIEKSVLGFRSNIASACDISESILLGDVKVGEGCVLRRVIVDKDVDIAPGTQIGVNLQEDKKIFHVSDDGIVVIPKGARVGY

SEQ ID NO: 29028 - protein, 180 aa, Ralstonia metallidurans
MDHGLEIATLGGGCFWCLEAVYQQVAGVRAVESGYTGGHVSQPTYHEVCAGDTGHAEVVRVTFDPSAINYREILEIFFSIHDPTQLNRQGNDVGTQYRSSIFTHSEAQRAVAEYVIGKLAAEHVYDAPIVTQVEPEQPYWPAEASHQNYYQEHPAQGYCAFVISPKLTKFRRDFSHRMRR

SEQ ID NO: 29029 - protein, 444 aa, Vibrio vulnificus
MSVYYTLCFLSAAAMLIAFVNSKIGKMQTTIAITAGSMVLSLLILIAGQNNWFHLTEIATQTMSSIDFEDFLLKGILGFLLFAGGLGIKLPNLKDQKWEITVLALGATLFSTFFIGFALYGICQLIGIQFDLIYCLLFGALISPTDPIAVLAIVKKLKAPRRISTQIEGESLFNDGFGLVIFVTLFTIAFGHETPTVGSVTMLFIQEAIGGILYGFALGLLFHYLICATDDHSMELLLTIGIPTAGYAFAEVLHVSGPLAMVVSGIMIGNWTRFIGFSKESEDHLDHFWELVDEFLNGVLFLLIGMSMLLFKFHQEDWILMAIAIPLVLIARYLSVFLSYIGFKRFRQYNPWSIKILTWGGLRGGLALAMALSIPSGIWVISDKLIDVKEIILVMTYAVVVFSILVQGSTITPMIEKAKKSEAEFEAKQSSVTVPEGKTESITS

SEQ ID NO: 29030 - protein, 307 aa, Bacillus cereus
MNVYRGVHELIGHTPIVEITRFSLPEGVRLFAKLEFYNPGGSVKDRLGRELIEDALEKGLVTQGGTIIEPTAGNTGIGLALAALQHDLRVIVCVPEKFSIEKQELMKALGATVVHTPTEQGMTGAIAKAKELVNEIPNSYSPSQFANEANPRAYFKTLGPELWDALNGEIDIFVAGAGTGGTFMGTASYLKEKNIDIKTVIVEPEGSILNGGKAGSHETEGIGLEFIPPFLKTSYFDEIHTISDRNAFLRVKELAQKEGLLVGSSSGAAFHASLLEAEKAAPGTNIVTIFPDSSERYLSKDIYKGWE

SEQ ID NO: 29031 - protein, 161 aa, Bacillus cereus
MIRKGEERRVYILGYIEELRKVVGTRPLILVGSAIIILNDNQEVLLQYRSDTYDWGVPGGAMELGETTEETARRELFEETGLNAKIMQFIGVLSGKEVYFQYPNGDEIFNVIHLYQGHHVSGELRLDHEGLQLQYFPVDKLPNLNKTTEKILQKFLYALTE

SEQ ID NO: 29032 - protein, 355 aa, Salmonella enterica
MSQKYLFIDRDGTLISEPPSDFQVDHFDKLAFEPEVIPVLLKLQKAGFKLVMITNQDGLGTQSFPQADFDGPHNLMMQIFTSQGVCFDEVLICPHLPADDCDCRKPKVKLVERYLAEQAMDSANSYVIGDRATDIQLADNMGITGLRYHRETLNWTMIGEQLTKRDRYAHVVRNTKETQIDVSVWLDREGNSKINTGVGFFDHMLDQIATHGGFRMEITVKGDLYIDDHHTVEDTGLALGEALKLALGDKRGICRFGFVLPMDECLARCALDISGRPHLEYKAEFTYQRVGDLSTEMIEHFFRSLSYTMGVTLHLKTKGKNDHHRVESLFKAFGRTLRQAIRVEGDTLPSSKGVL

SEQ ID NO: 29033 - protein, 391 aa, Arabidopsis thaliana
SASVAGVLQTPVSGKGGKAKKTSRSAKSNKSGTLASGSNAGSPGNNFAQAGTCRYDSSLGLLTKKFINLIKQAEDGILDLNKAADTLEVQKRRIYDITNVLEGIGLIEKTLKNRIQWKGLDVSKPGETIESIANLQDEVQNLAAEEARLDDQIRESQERLTSLSEDENNKRLLFVTENDIKNLPCFQNKTLIAVKAPHGTTLEVPDPDEAGGYQRRYRIILRSTMGPIDVYLVSQFEESFEDIPQADEPSNVPDEPSNVPDVPSNLPSTSGLPENHDVSMPMKEESTERNMETQEVDDTQRVYSDIESHDFVDGIMKIVPPDLDMGVDYWFRSEVGEVSITDMWPDEYWNQMITFDQDHAGPSDNKILEQPQTPSSPTPEESTATRSPTGS

SEQ ID NO: 29034 - protein, 449 aa, Nicotiana attenuata
MAASVENRQFSHLEAGLSRSFKPRSDSPVRGCNFPSPNSTNFQKKPNSTIYLDYSSSEDDDDDDEKNEYLQMIKKGNSELEPSVHDTRDEGTADNWIERNFSMIRLTGKHPFNSEPPLNRLMHHGFITPVPLHYVRNHGPVPKGTWDDWTVEVTGLVKRPMKFTMDQLVNEFPCRELPVTLVCAGNRRKEQNMVKQTIGFNWGAAAVSTTIWRGVPLRALLKRCGVFSKNKGALNVCFEGADVLPGGGGSKYGTSIKKEFAMDPARDIIVAYMQNGEKLAPDHGFPVRMIIPGFIGGRMVKWIKRIIVTTQESDSYYHFKDNRVLPPHVDAELANTEAWWYKPEYIINELNINSVITTPCHEEILPINAWTTQRPYTLRGYAYSGGGKKVTRVEVTLDGGETWQVSTLDHPEKPTKYGKYWCWCFWSLEVEVLDLLSAKEIAVRAWDET

SEQ ID NO: 29035 - protein, 507 aa, Staphylococcus aureus
MLNADLKQQLKQLLELMEGNVEFVASLGSDEKSKELKELLTEISDMSPRLSLSEKSLKRTPSFSVNRPGEETGVTFAGIPLGHEFNSLVLAILQVSGRAPKEKQSIIDQIKNLEGSFHFETFISLTCQKCPDVVQALNLMSVINPNITHSMIDGAVFREESENIMAVPAVFLNGEEFGNGRMTIQDILSKLGSTADASEFENKEPYDVLIVGGGPASGSAAIYTARKGLRTGIVADRIGGQVNDTAGIENFITVKETTGSEFSSNLAAHIDQYDIDAMTGIRATDIEKTDEAIKVTLENGAVLESKTVIIATGAGWRKLNIPGEEQLINKGVAFCPHCDGPLFENKDVAVIGGGNSGVEAAIDLAGIVNHVTLFEFASELKADNVLQDRLRSLSNVDIKTNAKTTEVVGEDHVTGIRYEDMSTGEEHLLNLDGIFVQIGLLPNTSWLKDAVELNERGEIVIDCNNNTNVPGIFAAGDVTDQKNKQIIISMGAGANAALNAFDYIIRN

SEQ ID NO: 29036 - protein, 450 aa, Idiomarina baltica
MSYVKETIDMLKRTSPAQNEFYQAVEEVLESIEPLLEEHPKYRQQAIIERLVEPERQIMFRVPWQDDKGQVHVNKGYRIEFNSALGPYKGGLRFHPSVNAGIIKFLGFEQIFKNALTGLPIGGGKGGSNFDPKGKSDAEIMRFCQSFMTELHRHIGPHTDVPAGDIGVGTREIGYLFGQYKRLKNRFEGVLTGKSLRWGGSHARKQATGYGAVYFAQCLLGDRGEKLSDKRCLVSGSGNVAIYAMEKLYELGATPVTCSDSNGMVYHKSGIDLDLVKQIKEENHERLKTYLDTHDDAEYIAREDYPEDGHSVWRYEGDIAFPCATQNELTEQDAQALAENGCLAVLEGANMPSTQAAVDFFVEQKIGYGPGKAANAGGVATSQLEMAQNAGMQQWSFDEVDRKLQEIMKTIYSDCKRTAEQFGSPNNLVLGANIAGFKKVADAMIEQGVV

SEQ ID NO: 29037 - protein, 174 aa, Vaccinium stamineum
FLSEACDLFFDAASSGKQFLIVGTKERVADSVARAAIRARCHYVNKKWLGGLLTNWSTTERRLRKFRKLRRMEQKIGRRNRLLKRNAARLKRKLSHLQVYLGGIKYMTGLPDIVIIIDQHKEYTALRECIILGIPTVCLIDTNCDPDLVDFPIPANDDTRASIQFILTKLVFAI

SEQ ID NO: 29038 - protein, 461 aa, Desulfitobacterium hafniense
MKKKWLGLGLGILILFTGYFWPETAGLTQPGKMSIAILMAGIVLWVTEVMPLAITALLLMVCMPYFEIFNWSTTWSKFISSVIFFIIATFAISVALIKTSLATRIAGVLIKWSQGNSKRLVLGFMAGTALLSAVCNNVPACSLFMSLALSILITDNAIPGKSNLGKCLMIGIPFGAMIGGTMTPAGTSINIMAMGLLEEATGITISFLDWMLMGIPFAIIIVPVCWLSLIMIFKPEDISQKSIDILQNRVVTTEKLNKEEKKIIIIIAVMLAAWIASTWIPWLDATGIAVMGLIAFFFPGIEVLSWDEFIKGVSWEVVLMIGGVNAVAAGIMSTGAAAWIVDSVMGGASGWSYPMLAGVTATVMAVLHGICPVGPAICGMATVPISGLAELINASPAVLTIIVAFGAGITFLLPLDCVPLITYGKGYYKMVDMVKAGIIPTIAVILVSAFILPPLGALIGL

SEQ ID NO: 29039 - protein, 916 aa, Oryza sativa
MAASVQPRQFGHLEPGSAPVCGAASSNGAKAYPPANGIPRRADSPVRGCGFPPLVSPPSRKPPSDGSDDEEEEQEDWRELYGSHLQLEVEPSVRDARDEGTADAWIERNPLLIRLTGKHPLNCEAPLARLMHHGFITPAALHFVRNHGAVPRGDWSTWTVEVTGLVKRPMRLTVDELVNGFPAVEVPVTLACSGNRRKEQNMVQQTVGFNFGAAAVSTSVWHGARLRDVLRRCGIMPSKGGALNVCFEGAEDLPGGGGSKYGTSITRQWALDPSRDIMLAYMQNGEPLLPDHGFPVRAIIPGCTGGRMVKWVKRIIVTTAESDNYYHYKDNRVFPSHVDAELANADAWWYKPEYIINELNVNSVITAPGHDEILPINGITTQRGYTMKGYAYSGGGKRITRVEVTLDGGETWLVCVLDLPEKPTKYGKHWCWCFWSVEVEVLDLLGAKEIAVRAWDQSHNTQPEKLIWNLMGMMNNCWFKVKVNVCRPHKGEIGLVFEHPTQPGNQTGGWMARQKHLETAEAAAPGLKRSTSTPFMNTTDGKQFTMSEVRKHSSQDSAWIVVHGHVYDCTAFLKDHPGGADSILINAGTDCTEEFDAIHSDKAKALLDTYRIGELITTGAGYSSDNSVHGASNLSQLAPIREAIKAPAPVALSSPRDKVPCQLVDKKELSRDVRLFRFALPSSDQVLGLPVGKHIFVCASIEGKLCMRAYTPTSMVDEVGHFDLLIKVYFKNEHPKFPDGGLMTQYLDSLPVGAYIDVKGPLGHVEYTGRGEFVINGKPRNARRLAMIAGGSGITPMYQVIQSVLRDQPEDTTEMHLVYANRTEDDILLRDELDRWAAEYPDRLKVWYVIDQVKRPEEGWKYGVGFVTEEVLREHVPEGGDDTLALACGPPPMIKFAVSPNLEKMKYDMANSFIVF

SEQ ID NO: 29040 - protein, 167 aa, Pernettya prostrata
FLSEACDLFFDAASSGKQFLIVGTKERVADSVARAAIRARCHYVNKKWLGGLLTNWSTTERRLRKFRKLRRMEQKMGRRTRLLKRNVARLKRKLSHLQVYLGGIKYMTGLPDIVIIIDQHKEYTALRECIILGIPTVGLIDTNCDPDLVDFPIPANDDTRASIQFIL

SEQ ID NO: 29041 - protein, 476 aa, Bacillus thuringiensis
MQNKIIVMFQKDFRLYDNPALFEAAQSGEVVPVYVHDETFSMGSASKWWLHHAIIDVKKQLEALGSTLIIRKGSTQEEILSLVEQLGITAVYWNICYDPDRLQFNQKMKMMLEHKGMICKEFNSHLLLEPWVIKKKDNTEYKVFTPFYNAFQKQVIHKPISKVQSIKGGNSLPVSLSVSELHLLPTIPWTSHMESIWEPTEEGAYKTWKEFFSSKLASYSEGRDFPNQNAHSMLAPYLSFGQISVKLIYHYLINKSTESQCSLFEKQVNSFIRQLIWREFSYYLLYHYPFTAYKPLNKSFEHFPWNNEEELLRVWQKGDTGYPFIDAGMRELWQTGFMHNRTRMAVASFLVKHLLIPWQEGAKWFMDTLLDADIANNTMGWQWVAGSGADASPYFRIFNPITQGEKFDKNGEYIREWVPELKDMPNKYIHKPWEAPEHILQKANIQLGHTYPLPVVDHKAARERALCAYKSMKEFV

SEQ ID NO: 29042 - protein, 174 aa, Leucothoe axillaris
FLSEACDLFFDAASSGKQFLIVGTKERVADSVARAAIRARCHYVNKKWLGGLLTNWSTTERRLRKFRKLRRMEQKMGRRNRLLKRNAARLKRKLSHLQVYLGGIKYMTGLPDIVIIIDQHKEYTALRECIILGIPTVCLIDTNCDPDLVDFPIPANDDTRASIQFILTKLVFAI

SEQ ID NO: 29043 - protein, 174 aa, Pieris phillyreifolia
FLSEACDLFFDAASRGKQFLIVGTKERVADSVARAAIRARCHYVTKKWLGGMLTNWSTTERRLRKFRKLRRMEQKMGRRNRLLKRDAARLKRKLSHLQAYLGGIKYMTGLPDIVIIIDQHKEYTALRECIILGIPTVSLIDTNCDPDLVDFPIPANDDTRASIQFILSKLVFAI

SEQ ID NO: 29044 - protein, 174 aa, Oxydendrum arboreum
FLSEACDLFFDAASRGKQFLIVGTKERVADSVARAAIRARCHYVNKKWLGGMLTNWSTTERRLRKFRKLRRMEQKMGRGNRLLKRDAARLKRKLSHLQAYLGGIKYMTGLPDIVIIIDQHKEYTALRECIILGIPTVCLIDTNCDPDLVDFPIPANDDTRASIQFILTKLVFAI

SEQ ID NO: 29045 - protein, 432 aa, Cucumis melo
  misc_feature (205)..(205): Xaa can be any naturally occurring amino acid
  misc_feature (215)..(215): Xaa can be any naturally occurring amino acid
MAQILAPSTQWQLRTKLTSMSSSPITPKMWSSILLKQNKKGAVKSSSKYRVLSVKSVGGTINRMEDLLNLDVTPYTDKIIAEYIWIGGSGIDLRSKSRTISKPVEHPSELPKWNYDGSSTGQAPGEDSEVILYPQAIFKDPFRGGNNILVICDAYTPAGVPIPTNKRHRAAEIFSNKKVVDEIPWYGIEQEYTLLQTNVKWPLGXPVGAYPGPQXPYYCGVGADKSFGRDISDAHYKACLYAGINISGTNGEVMPGQWEYQVGPSVGIEAGDHIWCSRYILERITEQAGVVLSLDPKPIEGDWNGAGCHTNYSTKSMREEGGFEVIKKAILNLSLRHKDHISAYGEGNERRLTGKHETASINTFSWGVANRGCSIRVGRDTEKQGKGYLEDRRPASNMDPYVVTSLLAETTILWEPTLEAEALAAQKLSLKV

SEQ ID NO: 29046 - protein, 256 aa, Saussurea medusa
MVRAPCFDKHGIKRGAWSQEEDNKLRAHIQRSGHSNWRQLPKLAGLSRCGKSCRLRWVNYLRPTIKHGNFTKDEKDVVVALHNKLGNKWSAIAARLPGRSDNEIKNYWHTHLKNRAQTDQTVLQTKQDGNAETSKGKGTPKAGCVVRKPNVKSQQEVEILLAVLSSASSSSFSSSTTSDQNESSPPSLSVSDANVTPQCSEEAARSLCIDQFLVEEDSIMLSSDKMYSPLGSVDYFISQDNVMDDVLLWPNLDFYY

SEQ ID NO: 29047 - protein, 376 aa, Aquifex aeolicus
MASSTKKDYYEILGVPRNASQEEIKKAYRRLVRKYHPDICKKPECEEKFKEINEAYQVLSDPEKRKLYDMYGHAAFEGAGAQQRVETTEIPPIEEILREFFDFDIGSIFERATGRRRARRRRSVKGEDIVVPVEITLEEAFKGTTVPIEVEREVPCSACGGTGYDESKSRTCPTCGGRGETVQGNWFFQVRQTCPTCGGEGVIYENCHACTGRGYGLVKETIKVKIPPGVRDGSKLVVEGKGHAGRYGGPPGDLYIIVKVKPHKIFERKGDDLYVDVNITYPEAVLGTEVEVPTLDGEKVKVKIPPGTKEGELIKVPGKGMPRLKGSGRGDLYVRVHIDVPKIGVLSKLLGDGKKVEELLKQLQEVLPKPERIVER

SEQ ID NO: 29048 - protein, 378 aa, Arabidopsis thaliana
MAVVDVHRFAESITCHAWSPDLSMVALCPNNTEVHIYKSLSQDHWERLHVLQKHDQIVSGIDWSSKSNKIVTVSHDRNSYVWSLEGAEWVPTLVILRLNRAALCVQWSPKENKFAVGSGAKTVCICYYEQENNWWVSKLIRKRHESSVTSVAWHPNNVLLATTSTDGKCRVFSTFIKGVDTKDSKAGSPAETKFGEQILQLDLSYSWAFGVKWSPSGNTLAYVGHSSMIYFVDDVGPSPLAQSVAFRDLPLRDVLFISEKMVIGVGYDSNPMVFAADDTGIWSFIRYIGEKKAASSGSSYSSQFSEAFGKFYGSQSKSTTANDASDSRGGVHDNSITSIVPLGKGGSPKVMRFSTSGLDGKIAIWDLENMQQELGNQF

SEQ ID NO: 29049 - protein, 393 aa, Pichia jadinii
MLRIGKLNLSTMSSAQQRLAQVGSHLTAQKQSLAPQRPYKITVIGSGNWGTTIAKVLAENAGLRPHLFQHQVDMWVFEEKINGVNLTEIINTQHENVKYLPGIKLPKNLHAEPSIVKAAEGADLLVFNIPHQFLPGICKQLSKATLKPHVRAISCLKGLEVTPNGCKLLSTYITEHLGVHCGALSGANLAPEVAKEKWSETTVAYRLPNDFQGHGKDIDRYVLRAAFHRPYFHVRVIEDVAGVSLAGALKNVVALGVGFVHGLNWGDNAASAIQRFGLNETIKFAEVFFPGETNQDTFTKESAGVADLITTCSGGRNVRVAKAMAITGKSAVEVERELLNGQSAQGIITSKEVHELLAAKNLTKEFPLFEAIYQIVYGTESIERLPELIEEDE

SEQ ID NO: 29050 - protein, 239 aa, Arabidopsis thaliana
MLRSTCCTPLCPFTAKQPSFLRKQQRITSDRFTFRGGGGGDAAAVVSSSGLRDLVFVVNPQGANGRTAKEWKKLLPHLRSRLGKDCNVSELLTSGPSHAIDITREAIRDGADAVIAVGGDGTLHEVVNGFFWEGKPVGYLSGEASRSTALGLIPLGTGSDFARTFGWNNDPCEAVERIARGMRSRIDVGVIDKEGKDLHYFINVADVHLSAGRILRFKIQEIWKLVLRNWCPTSVHGPS

SEQ ID NO: 29051 - protein, 448 aa, Lactococcus lactis
MAHIKFDYSKLTPFVAENELDEIQWQIDGAAKLLHEGKGAGSDYIGWLDLPEDYDKEEFARIQKAAKKIQSDSEVLIVIGIGGSYLGARAAIDFLSNSFVNLQTAEERKAPRILYAGNSISSSYLADLVDYVADKDFSVNVISKSGTTTEPAIAFRVFEEMLVKKYGREEANKRIYATTDKEKGAVKVNADANNWETFVVPDSVGGRFSVLTAVGLLPIAASGADITALMEGANAARKEYTSTNVHENDAYAYAALRNILYRKGKFSEILINYEPSLQYFSEWWKQLAGESEGKDQKGIYPTSANFSTDLHSLGQWIQEGTRTVFETAIRIEKPRKNINIPELDADLDGLGYLQGKDVDFVNKKAADGVLLAHTDGNVPNMIVTLPEQDEFTLGYAIYFFELAIGVSGYLNGINPFNQPGVEAYKKNMFALLGKPGFEELSKELNDRL

SEQ ID NO: 29052 - protein, 550 aa, Salmonella enterica
MFCVQCEQTIRTPAGNGCSYAQGMCGKTAETSDLQDLLIAALQGLSAWAVKAREYGIINHDVDNFAPRAFFSTLTNVNFDSPRIVGYARDAIAMREALKAQCLSVDANAHCDNPMADLQLVSDDLGELQRQAAEFTPNKDKAAIGENILGLRLLCLYGLKGAAAYMEHAHVLGQYDNDIYAQYHKIMAWLGTWPADMNALLECAMEIGQMNFKVMSILDAGETTKYGHPTPTQVNVKATEGKCILISGHDLKDLYNLLEQTEGTGVNVYTHGEMLPAHGYPELRKFKHLVGNYGSGWQNQQVEFARFPGPIVMTSNCIIDPTVGSYDDRIWTRSIVGWPGVSHLEGDDFGPVIAQAQQMAGFPYSEIPHLITVGFGRQTLLGAADTLIDLVSREKLRHIFLVGGCDGARGERNYFTDFVTSVPDDCLILTLACGKYRFNKLEFGDIEGLPRLVDAGQCNDAYSAIILAVTLAEKLGCGVNDLPLSLVLSWFEQKAIVILLTLLSLGVKNIVTGPTAPGFFTPDLLAILNEKFGLRSVTTVEEDMKQLLSA

SEQ ID NO: 29053 - protein, 112 aa, Unknown
  Sulfitobacter sp. EE-36
MKKIEAVIKPFKLDEVKEALQEVGVQGLSVIEVKGFGRQKGHTELYRGAEYVVDFLPKVKIEIVLDDDQVDAAIEAIVSAAKTEKIGDGKIFVSPIEQTIRIRTGETGSDAL

SEQ ID NO: 29054 - protein, 180 aa, Oenococcus oeni
MANEIQTAIFAGGCFWCMVEPFDSLPGIIKVRSGYTGGHVDHPTYEQVSSHQTGHTEAVKIWFDPKKISYAELVDLYWQVTDPTDAGGQFQDRGDNYRPVIFVNSDSQHQTALSSKQKLLDSGVFGEDPIVTKIEKAQTFWEAEDYHQDFYKYNQARMKVQDAPREDFIKEHWNKQKADD

SEQ ID NO: 29055 - protein, 666 aa, Cryptococcus neoformans
MSGNVACARVRSQSSTFSPLETRDGDEQESSSSDSQHGSSKRGPQRRATDLPSAADLYVPSLPGLPEMATHPTHPLNIYAGMLPSYPGEGKVGGEGQTGKDAKLYFLMAKARRNAGKERVIFWFNGGPGCSSFDGSLMEVGPFRTVPATETTSGMVEAKLVEGGWEEFATVVFVDQPPGTGYSYAATDGYLHDFDELSAHFIEFLQNFYTVFPELKGVDTYLAGESFAGQYIPFFADALIKSIELPNFPLKGIAIGNGWIDPKEQYPGYVEFAYEKGLIVSGTPEAEEMESALKRCQEEMDKYSDPFTTPVNINNCGQVMDSVTRPFTQELNGKKVCMNVYDVRLVDDFPACGMNWPPDLPDVYTFLRQDDVISALHATSKETAWVECNNKVSYELNLKKSHMSAALLPSILEAGVPILMFAGAEDLICNYKGIERIVNGLEWDGEKGFGNATSQEWYFNGTQVGTWQTSRGLSYAKIFDSSHMVGFDVPHVSNDMIMRFMDVDVSLLPGMTAQWPSRIGDDERTMIHVGDGESGGVPLIEGGNTDWEAWYNAIFAFLVLGILVSIAGLYFYFRRKPVSYRSRISLKQRSRRHRGHDMDEDEAAERMPLGSERLELDDIERAEGYEFHDGDGERYSREGKGKGKERAKDREEVVFALGDDDEDDHH

SEQ ID NO: 29056 - protein, 921 aa, Oryza sativa
MASKGTGGGHGGVERKEQQQQRGYQLPRDSRGSLEVFNPSSASSFRTAAAAAKSASPFLAIPDREEDNVVAQQRAAEWGLVLQTDYHTGLPQGVSTRPSSCSARTSSEDTPQQQQSAAAIPRVSEELRAALSAFQQTFVVSDATRPNHPIMYASAGFFNMTGYTSKEVVGRNCRFLQGSGTDPHEIDKIRQALANGSNYCGRILNYKKDGTPFWNLLTIAPIKDEDGRLLKFIGMQVEVSKYTEGKKETVVRPNGLSESLIKYDARQKDHARSSVSELLLALKNPRSLSESSNNTLKRKSQESLSMSMSEVPSKRSSESGSRRNSRSGTRSSLQKINEVPDQVNRTRKSGLRAFMGFLGMGHGSVEKNMLKPRDEDPLIDSDDERPESFEDEFRRKEMRRGIDLATTLERIEKNFVITDPRLPDNPIIFASDSFLQLTEYNREEILGRNCRFLQGPETDRAIVRKIRDAIDNQAEVTVQLINYTKSGKKFWNLFHLQPMRDQKGDVQYFIGVQLDGTEHVQDDAAEEGVVLVKKTADNIDEAAKELPDANLRPEDLWANHSKVVLPNPHMKDTASWRAIQKVLESGESIGLKHFRPIKPLGSGDTGSVHLVELLNTGEYFAMKAMDKSIMLNRNKVHRATAERQILDLLDHPFLPTLYASFQTKTHICLITDYCPGGELFVLLDNQPLKVLHEDAVRFYVAEVVIALEYLHCQGIIYRDLKPENILLHRDGHISLTDFDLSCLTSCRPQVFLPEDADEKKGRKNRSYPIFFAEPMRASNSFVGTEEYIAPEIITGAGHTSAVDWWALGILLYEMLYGYTPFRGKTRQRTFANILHKDIRFPASILVSLAARQLMYRLLHRDPANRLGSYEGANEIKGHPFFRGINWPLIRATAPPKLEIPLFSKDDMEKKGLVTDNRTDIF

SEQ ID NO: 29057 - protein, 162 aa, Triticum aestivum
  misc_feature (73)..(73): Xaa can be any naturally occurring amino acid
  misc_feature (95)..(95): Xaa can be any naturally occurring amino acid
  misc_feature (106)..(106): Xaa can be any naturally occurring amino acid
ARCCAASPRPVGFSSKRARRASHSWRLGFEKGDAYFFKQMGKGMLCTYALFGAAWFWNETSPLGWGTLKPRPXEKKEMAHLYERREFPYPGDEEXKLRDFKKRGGXLGTTIGPRGVPETQTWTRNNMEKAPGTPGNFDPGGAGNWGSREPQRRGGEEAPGRR

SEQ ID NO: 29058 - protein, 435 aa, Aspergillus oryzae
MILFSTSRESLLRPQWNPLRLQNNLPNGSTIATTKLQSSTPSPSPVIKEQSLPARAISVVVPSPSSQLKKEIESAKWASSSQSCTPELKGVLEKFYPTNAHVERGRKGAYPAARKVNRAAIPLPTGTPGPILQKRPEALDQQYRTLERKLSTIKGPKITFAPADGPKLAKVTANFQFINSYKLHKGVSPAPAEFIGGCSCGKHCDPERCPCSEKEDDSTENIIPYQRAKDRPDLLVLTPEFLRRTAMIFECGAQCACDKSCWNRVVQRGRTVELEIFYTGNRGFGLRSPRYIREGQFIDCYLGEVITKQHADIREETAVKNGHSYLFGLDFSPEVDEEDIYVVDGQRFGCATRFMNHSCKPNCRMFTVTNTIGDERLYNLAFFALKDIPPMTELTFDYNPGTERSEKVDSSVVACLCGEDNCRGQLWPSKRKGTK

SEQ ID NO: 29059 - protein, 472 aa, Coprinopsis cinerea
MKLLLPVVLLQLWLVNAMSLVARNNRSSSFVTVKDGRFSLDNQLFRFYGTNAYWIQMTTDDDMENTFHAIATAGYNVVRTWAFNDVPSKPASGPYFQVLNSNGGTINEGNDGLKRLDKAVSLAQKYGIKLLLSLTNNWNPERPVPNTAWNRRANTRELPRGYLSNDYGGMDAYVRAFRPNGTHDSFYTDGTIIEAFKNYVSHVVKRYANSPAVLAWELGNDLRCSSTLPASNNCNTGTITNWTADISSFIKSIDSNHLITAGDGGFYCLKCPKRFAKDFTKPTSSLPGSAFDGSYGVDTEDILAIPSIDFGSFQLFPDQVNYFPTVDDSFATKAIGDGGKWISAHSNTASRLGKPEALTAASILGKENYSSFAPFNSTSQIPDGTPCAGVEPFQVDYAFTSWAGVALHGNIGGVLEYQWQQDGLTSHGTIHENWEKRALTESPQDGSARYKGPASGQNAEQFAADLPPIEDE

SEQ ID NO: 29060 - protein, 716 aa, Synechococcus elongatus
MPQLSKSLSFDGRDIRLELGLFAPQAGGSVLISSGDTAVLVAATRSTAREGIDFLPLTVDYEERMYAAGRIPGGFLRREGRPPERATLTSRLIDRPLRPLFPSWLRDDLQVVATTLSMDETVPPDVLAATGASIATLVAKIPFYGPMAAVRVGLVGDDFIINPTYREIEKGDLDLVVAGTPAGVIMVEAGANQLPEADVIEAIDFGYEAVQELIKAQQSLLAELGIEQILPEAPNADNTLENFVRDRASSGVQQVLQHFSFTKSERDAALDEVKASVVEAIAALPEEDPVRSVTAAEPKALGNTFKALTKTLMRQQILRDGVRVDGRKLDQVRPISSQVGLLPPRVHGSGLFQRGLTQVLSIATLGTPGDAQELDDLHPDTQKRYLHHYNMPPYSVGETRPMRSPGRREIGHGALAERALLPVLPSKEEFPYVIRVVSEVLSSNGSTSMGSVCGSTLALMDAGVPIKKPVSGAAMGLIREGDEYRVLTDIQGIEDFLGDMDFKVAGTDQGITALQMDMKIHGLPLEIIADAINQAKPARLHILNKMLEAIATPRADLSTYAPRLFRIQINPEQIGLVIGPGGKTIRSITEQTGAKIDIEDTGAVTISAVDADSALRAKSIIEGMTRTITAGDVYIGKVTRIIPIGAFVEFLPGKEGMIHISQIADYRVARVEDELTVGDEVVVKVREIDQKGRVNLTRKGIDPEEVSAARAAVEAS

SEQ ID NO: 29061 - protein, 420 aa, Sinorhizobium meliloti
MVEKRTQPLARDAMAYVLAGGRGSRLKELTDRRAKPAVYFGGKARIIDFALSNALNSGIRRIGVATQYKAHSLIRHLQRGWNFFRPERNESFDILPASQRVSETQWYEGTADAVYQNIDIIEDHGVEYMVILAGDHVYKMDYELMLQQHVDSGADVTVGCLEVPRMEATGFGVMHVDNADRIIAFVEKPADPPGIPGNPDMALASMGIYVFHTKFLMDMLRRDAADPKSSRDFGKDIIPYIVEHGKAVAHRFTHSCVRSDFEREAYWRDVGTIDAYWQANIDLTHITPELDIYDSTWPIWTFSEIKPPAKFVHDDENRRGSATSSLVSGDCIISGAALNRSLLFTGVRVNSYSRLENAVVLPDVTIGRHSILRNVVIDSRVVIPEGLVVGDDPELDAKRFRRTESGVCLITQTMIDKLGM

SEQ ID NO: 29062 - protein, 458 aa, Streptococcus agalactiae
MENHRYEDEGKFQRKMTSRHLFMLSLGGVIGTGLFLSSGYTIAQAGPLGAVLSYLIGAVVVYLVMLSLGELAVAMPVTGSFHTYATKFISPGTGFTVAWLYWICWTVALGTEFLGAAMLMQRWFPNVPAWAFASFFALVIFGLNALSVRFFAEAESFFSSIKVIAIIIFIILGLGAMFGLVSFEGQHKAILFTHLTANGAFPNGIVAVVSVMLAVNYAFSGTELIGIAAGETDNPKEAVPRAIKTTIGRLVVFFVLTIVVLASLLPMKEAGVSTAPFVDVFDKMGIPFTADIMNFVILTAILSAGNSGLYASSRMLWSLANEGMLSKSVVKINKHGVPMRALLLSMAGAVLSLFSSIYAADTVYLALVSIAGFAVVVVWLAIPVAQINFRKEFLKENQLEDLSYKTPFTPVLPYITIILLLISIVGIAWDSSQRAGLYFGVPFIIFCYIYHKLRYKKW

SEQ ID NO: 29063 - protein, 198 aa, Synechococcus elongatus
MKRLLVLGLLIASFWFPNTAAWAATAEAIFAGGCFWCVEADFDKVTGVTETISGYSGGTVKKPTYKQVSAGKTGHYESVKIIYDPDQVSYDQLVSYFLQHIDPLDGGGQFCDRGDQYRSAIFVTPEQQPIAEAAIAAAAQELGQPIQTKIQPAKEFWEAENYHQNYYQKQALLYKYYRARCGRDAQIAKVWGEYEQQS

SEQ ID NO: 29064 - protein, 729 aa, Unknown
  Frankia sp. CcI3
MDDSTHAAEAVIATPAGDRTVRFETGRLAKQAAGSAVAYLGDTMVLSATTVSKQPKEQLDFFPLTVDVEERMYAAGRIPGSFFRREGRPSEDAILTCRLIDRPLRPSFAKGLRNEIQVVATVLALDPDTLYDVVAINAASASTTLSGLPFTGPIGATRVGFVDGEWIAFPTHAELARATFDMVVAGRVIEDGSDVAIMMVEAEATPGTVELLAHGAPAPTEEVVAAGLEAAKPAIRELCRAQSELAALAAKPAREFPVFIDYHDDVLDALSAAIGDELSAALRIPGKAERENELDRVRQLAAEKVASQFEGREKEIGAAYRALTKKLVRSRIVTESVRIDGRSTTEIRALSAEVDYIPRVHGSALFERGETQILGVTTLAMLRMEQTVDTLNPDRTKRYMHNYNFPPYSTGETGRVGSPKRREIGHGALAERALLPVLPSREEFPYAIRQVSEALGSNGSTSMGSVCASTLSLLNAGVPLKAPVAGIAMGLIHADDSYVTLTDILGAEDAYGDMDFKVAGTRDFVTALQLDTKLDGIPASVLAAALQQARGARLAILDVMAEAIGSPDEMSAHAPRVISVKIPVDKIGEVIGPKGKMINQIQADSGAEITVEDDGTIYIGAVDGPSAESARSAINAIANPQMPEVGERYLGTIVKITNFGAFVSLTPGRDGLLHVSKLKTLSGGKRVEKVEDVLTVGQKLQVEITEIDSRGKISLSPSAEAADAAAAAS

SEQ ID NO: 29065 - protein, 468 aa, Salmonella enterica
MSKQQIGVVGMAVMGRNLALNIESRGYTVSVFNRSREKTEEVIAENPGKKLVPYYTVKEFVESLETPRRILLMVKAGAGTDAAIDSLKPYLEKGDIIIDGGNTFFQDTIRRNRELSAEGFNFIGTGVSGGEEGALKGPSIMPGGQKDAYELVAPILTKIAAVAEDGEPCVTYIGADGAGHYVKMVHNGIEYGDMQLIAEAYSLLKGGLNLSNEELANTFTEWNNGELSSYLIDITKDIFTKKDEDGNYLIDVILDEAANKGTGKWTSQSALDLGEPLSLITESVFARYISSLKAQRVAASKVLSGPKAQPAGDKAEFIEKVRRALYLGKIVSYAQGFSQLRAASDEYHWELNYGEIAKIFRAGCIIRAQFLQKITDAYAENAGIANLLLAPYFKKIADEYQQALRDVVAYAVQNGIPVPTFSAAVAYYDSYRAAVLPANLIQAQRDYFGAHTYKRTDKEGIFHTEWLE

SEQ ID NO: 29066 - protein, 259 aa, Bacillus cereus
MKVACIQMDIVFGDVEKNIENAKNKISEAMKERPDVIVLPELWTTGYDLTRLSEIADRDGLETKEKLIEWSKQYGVHIVGGSIAKQTEQGVTNTMYVVTNKGELVNEYSKVHLFQLMDEHKYLIAGNSTGEFKLDDVECAGTICYDIRFPEWMRVHTAKGAKVLFVVAEWPLVRLAHWRLLLQARAVENQCYVVACNRAGKDPNNEFAGHSLIVDPWGEVVVEANEEESILFGELTFEKIKEVRKGIPVFADRRPELYK

SEQ ID NO: 29067 - protein, 296 aa, Thermotoga maritima
MRTLKELERELQPRQHLWYFEYYTGNNVGLFMKMNRVIYSGQSDIQRIDIFENPDLGVVFALDGITMTTEKDEFMYHEMLAHVPMFLHPNPKKVLIIGGGDGGTLREVLKHDSVEKAILCEVDGLVIEAARKYLKQTSCGFDDPRAEIVIANGAEYVRKFKNEFDVIIIDSTDPTAGQGGHLFTEEFYQACYDALKEDGVFSAETEDPFYDIGWFKLAYRRISKVFPITRVYLGFMTTYPSGMWSYTFASKGIDPIKDFDPEKVRKFNKELKYYNEEVHVASFALPNFVKKELGLM

SEQ ID NO: 29068 - protein, 417 aa, Bacteroides thetaiotaomicron [sequence omitted]

SEQ ID NO: 29069 - protein, 325 aa, Staphylococcus aureus
MSVNGYGKVYLIGAGPGNPNYLTKKAERLIREADVILYDRLVNPLILQYSKSTTEIIDVGKKPYAKHIQQEKINECIVEAARRYNKVVRLKGGDPAIFGRVQEEVDTLNNFNIAFEIVPGVTSASAAVATMQTGLTMRAVAKSVTFSTGYFKDSEENEVDVNALVNGGTLAIYMGVKRLEKIIAQIQQYTDIDYPIAIVFQASCFNEFVVKGRLSNIVGKLEHYAIEAKPGICIIGEVVGYTENVSTTSNPTQQFYVVSGSKPDALMLCEHLYDEGYGCLLNPNDTSNGTYHSSQYDYYDTFIKQQENVTYISTDRADTNTVLCH

SEQ ID NO: 29070 - protein, 360 aa, Bacteroides thetaiotaomicron
MKQEFTRIAVKVGSNVLARRDGTLDVTRMSALVDQIAELNKSGVEIILISSGAVASGRSEIHPQKKLDSVDQRQLFSAVGQAKLINRYYELFREHGIAVGQVLTTKENFSTRRHYLNQKNCMTVMLENGVIPIVNENDTISVSELMFTDNDELSGLIASMMDAQALIILSNIDGIYNGSPSDPASAVIREIEHGKDLSNYIQATKSSFGRGGMLTKTNIARKVADEGITVIIANGKRDNILVDLLQQPDDTVCTRFIPSTEAVSSVKKWIAHSEGFAKGEIHINECATDILSSEKAASILPVGITHIEGEFEKDDIVRIMDFLGNQVGVGKANCDSAQAREAMGKHGKKPVVHYDYLYIE

SEQ ID NO: 29071 - protein, 170 aa, Rhododendron arboreum
FEACDLVFDAARRRKRILIVGTKKRVADLVARAAIKARCHYVNKKWLGGMLTNWSTTERRLCKFKKLRLELKMVRRNLLKRDAARLKRKLSHLQTYLGGIKYMTAIPDIVIIIDQHKEYTALRECIILGIPTICLIDTNCDPDLVDFPIPANDDTRASIRFILSKLVFAI

SEQ ID NO: 29072 - protein, 275 aa, Oryza sativa
MVVADLVWAVDSYGVRLVDWGAAGCSLQLQMVDSSEGFRRLAALLFKCCSLDSSNRPNGLQDPERLARETVFNVNEIEALYELFKKISSAVVDDGLINKEEFQLALFKTNRKDSMFADRVFDLFDTKHNGILGFEEFARALSVFHPNAPIDDKIDFAFKLYDLKQQGFIEKQEVKQMVVATLAESGMNLSDEIIEGIIDKTFEEADTKHDGKIDKEEWRNLVLRHPSLLKNMTLPYLSNSLYRVCKPRSSSTQESGMPLFDRAQQGEHSSSEAVI

SEQ ID NO: 29073 - protein, 329 aa, Thermoplasma acidophilum
MKVNKIHKSNLHLCFMESGEINTLIEEISEHLEKPELYHALKVQSSIRSITSEFLKERGFIEVPPVIISVLTDPLNHPVFDPTIDYYGYKYSLTKSMIFHKHLLTKHFDRIFTFSPNIRLEEEDKVKTGRHLAEFTQLDLEMKGASRDEVMSLGEDMIIDLFKKIKRSNEEDLKFFGRDLRIPSKPFKRIAYLDAYKQYGEDFEHILSSEMKEPFWIIDIPLEKREFYDREDPSRPGILVDMDLIYPEGFGEALSGGEREYELSRIIDRIHRKGQTEEQFKWYIEFAKEGLMPSAGFGIGIERLTRFICGLERIEDAHPFPKIPGHLSL

SEQ ID NO: 29074 - protein, 801 aa, Staphylococcus aureus
MAKQKLVMIGNGMAGIRTIEEILERANDLYDITVIGKEPYPNYNRIMLSNILQNKMTVEETIMNPYEWYEEHDIKLITNDPVVDVDRANQNVTTANGIEVAYDKLIFATGSKAFVIPVPGSTLPSVIGWRTIDDTEQMMNIAKTKKKAIVIGGGLLGLECARGLLDQGMEVTVLHLAEWLMEMQLDRKAGNMLKADLEKQGMKFEMQANTTEILGEDDVEGVKLADGREIPTDLVVMAVGIRPYTEVAKESGLDVNRGIVVNDVMQTSDSNVYAVGECAEHNGKVYGLVAPLYEQGKVLADHLTNKETNGYKGSTTFTSLKVSGCDLYSAGQIVENAEIKGIEIFNSVDNNYKKIFLKDGNVVGAVLYGDIDDGSRFYNMMKKGESTEDYTLVSLLTKGGEEASLSIADMADDETICGCNGVDKGTIVNAITENGFTTVEEVTAKTKAGNSCGKCKPQIAQILQHTLGDDFVAAKPAGICGCTDLTRDQIVTQIRAKGLKTSKEVRHVLNFKNKGGCPKCRPAINYYLNMVYPHDHEDERESRFANERYHANIQNDGTFSVIPQMRGGVTDADQLIRLGEVAKKYHVPLVKVTGSQRVGLYGVKKEELPNIWEDLGMRSASAYGKKTRSVKSCVGKEFCRFGTQYTTRLGIRLEKTFEYIDTPHKFKMGVSGCPRSCVESGVKDFGIISVENGFQIYIGGNGGTEVEKAEFLTTVETEDEVIKLCGALMQYYRETGIYAERTAPWLRRLGFENVKEVLLDPERQNELFERIMDAKKAVEAEPWEAITSNAQARKIFEVEKV

SEQ ID NO: 29075 - protein, 172 aa, Rhododendron groenlandicum
FLSEACDLVFDAARRRKRILIVGTKKRVADLVAQAAIKARCHYVNKKWLGGMLTNWSTTERRLCKFKKLRLELKMVRRNLLKRDAARLKRKLSHLQTYLGGIKYMTAIPDIVIIIDQHKEYTALRECIILGIPTICLIDTNCDPDLVDFPIPANDDTRASIRFILTKLVFAI

SEQ ID NO: 29076 - protein, 276 aa, Prochlorothrix hollandica
LDLGMADPLGFELFDQCWVLFRDDQGTAACILDECAHRACPLSLGKVIQGRIQCPYHGWEYDRQGECVHMPSCQAISNPILTLPVMEQGGMIWVWPGTDEPGALPSLAPTLPDNFTLQAELVMDLEVEHGLMLENLLDLAHAPFTHTGTFAKGWPVPPFVRFANAATTPWTGHWDPYPIHMTFEPPCFVISTIGLRGKDCGRHLHQVHACLPRGQGRTRLLYRLALDFGHWLRWVPGTHCLWQHLANRVIQEDLRLVQGQQERLKGGANVWNQPVG

SEQ ID NO: 29077 - protein, 173 aa, Enkianthus chinensis
FLSEACDLVFDAASRGKQFLIVGTRREAADSVEGAALTARCHYVNKKWLSGALTNWSITEKRLRLLRDLKMEQKMDKLNRFPYASAAMFKRNFSHLEECLNGMKYMTGLPDIVIIVDQHQDSTALRECINLGIPTISLMDTNCDPDLGDFLIPANDDTRASIRFILSKLVFAI

SEQ ID NO: 29078 - protein, 276 aa, Glycine max
MENAEEQQQQNEEVLSVELPAPSGWNKLFFPKKVGTPRKSEIVFIAPTGEEINTKKQLEQYLKAHPGNPVISEFDWGTGETPRRSARISEKVKSTPPADSDTPKKRARKSSGSKKDNKETESASEEGKAKSETEDPKAAEEEEDNEGNNDSGGKQLENGDKTEQIDEKAKKSDVDMEETDLNDTNNKLENDSAEIKNSHVKGENVITEKPEGEEAQKLEIEPAEKVAEEAADTEKSQGPLLTTELEKEENEEKTDTVILDANGGVEKENPNAAAEM

SEQ ID NO: 29079 - protein, 490 aa, Triticum aestivum
  misc_feature (245)..(245): Xaa can be any naturally occurring amino acid
MAAAAKLTRSFSRQLSSGAARVWRQLSLEPHTPRRGAAAATGAVAAAGPTRFGLARQSSLDPTPAPDDGAVLAMPENLDATMRLLYAACQGDAAGVEELLREGVDVDSIDFDGRTALHIAACEGRGEVVRLLLGWKANINARDRWGSTPAADAKHYGHFEVYNLLRARGAKLPKTKKTPMTVSNPKEVPEYELNPLELEFRRGEEVTKGYYVAKWYGSKVFVKILDKDSFSDGDSISVVISTQRXFKHELTLLEKARHPNLVQFVGAVTQNVPLMIVSEYHQKGDLASYLETKGRVQSYKAIRFALDIARGLNYLHECKPEPIIHGDLSPKNIVRDDEGKLKVAGFGSLDLTKVSQDKLQMVQPVSNFDSVYIAPEMYRNEAFDRSVDTFAFGLILYEMIEGSPAFHPKPQEEAAKMICSEGLRPLFKNKPKSYPEGVKELIQECWDPTPSVRPTFSDIIERLNKISASCSKQTRWRDNFKLPWKQAVHK

SEQ ID NO: 29080 - protein, 418 aa, Desulfovibrio desulfuricans
MQAARIISSKTHTQDETMKALEIKKDVFWVGAVDYDSRDFHGYSLSPQGTTYNAYVVKDEKTVLFDNVKEGFLPTMLCRLSQVTELEKIDYIVCNHLEPDHAGCLPELIERCKPEKIYCSPMGKRSMEAHFDTTGWPVEVVKTGDSINIGKRDIQFVETRMLHWPDSMVSYIPQDKLLICNDAFGQNIACTERFADEIDRAHLAHAMKEYYHNIVLPFSPIVIKTLDLLAELKLDIDMLAPDHGLIFRGEDVQYALDSYRSFAQQKPRKRAVIVFDTMWHSTEKMARAIADGLEAEGVPARLMWLKANHHSAVMTELADCGAVIVGSPTHNNGIMPNVAKMLTYMKGLRPQNKVAAAFGSFGWSGESVKNITGWLEDMGFEVPAEGVKCKHVPKHETYEECYNLGKAVAQALKAKCEA

SEQ ID NO: 29081 - protein, 459 aa, Arabidopsis thaliana
MKQSEINNNTVPGNDTETTGSKLDQLSRAVPLGLDEFKSRASNSRDKSLSGQVTGVIHRMEPGGKEYNYAAASKGAKVLSSNKEAKGASSIICRDKDKYLRNPCSTEGKFVVIELSEETLVNTIKIANFEHYSSNLKDFEILGTLVYPTDTWVHLGNFTALNMKHEQNFTFADPKWVRYLKLNLLSHYGSEFYCTLSLLEVYGVDAVERMLEDLISIQDKNILKLQEGDTEQKEKKTMQAKESFESDEDKSKQKEKEQEASPENAVVKDEVSLEKRKLPDPVEEIKHQPGSRMPGDTVLKILMQKIRSLDVSLSVLESYLEERSLKYGMIFKEMDLEASKREKEVETMRLEVEGMKEREENTKKEAMEMRKWRMRVETELEKAENEKEKVKERLEQVLERLEWMEKKGVVVFTICVGFGTIAVVAVVFGMGIVRAEKQGGLAWLLLLISSTFVMFILSL

SEQ ID NO: 29082 - protein, 174 aa, Enkianthus chinensis
FLSEACDLVFDAASRGKQFLIVGTRREAADSVEGAALTARCHYVNKKWLSGALTNWSITEKRLRLLRDLKMEQKMDKLNRFPYASAAMFKRNFSHLEECLNGMKYMTGLPDIVIIVDQHQDSTALRECINLGIPTISLMDTNCDPDLGDFLIPANDDTRASIRFILSKLVFAIC

SEQ ID NO: 29083 - protein, 424 aa, Coccidioides immitis
MASLPLPSSTSHKPTASLDLSKKLSSLRTNRRNPSALSSQAAAPPTPQLPDRPTLTQHQFIRPVPRILSPQDLETFLSSPAHSLIIAFVFNVSDSVRQQSVSSLVQLPVSETIRKVLSILSAIEELIDKHPSLDQNGSRFGNPAFRDLFDDIAAHSVQWHKDILGLDDPAAIEEVSTYLIHSLGSRSRLDFGSGHELNFMMWLLCLYLFGMLDRNDFPVIVCHVFIRYMKLMRHVQTTYYLEPAGSHGVWGLDDYHFIPFLFGAAQLTGHPYITPLAIHNNVVLDEEGDNWIYLDQVRWVDSVKTVKGLRWHSPMLDDISGAKNWYKVEAGMKKMFVKEVLGKLPIMQHFLFGSLIPALPEMGERNEKAEQPDPGSGHPHGHAHSHQNDFWGDCCGIKVPSAVAAGEEMRKRQGGTGLRPIPFD

SEQ ID NO: 29084 - protein, 276 aa, Prochloron didemni
QNVNTTTPMPFELFDRSWILFRDRNSNIGCIHDRCAHRACTLSLGKVVNGRVQCAYHGWEYNTEGTCEVMPSCKQTKAAVKALPAIEQSGMIWVWPGSGVPGELPKLAPAIPENFTLQAEITMELDVEHGLFMENLLDLAHAPFTHTGTFAKGWPVPDFVRFANLPKTPLTGHWDPYPIDMSFEPPCYVISTIGLRGRDCGRHLHQVHVCLPKGKGKTRLLYRLALDFYKWLRFVPGMNLFWEHMAQRVIGEDIRLVRGQQKSLQEGGNVWNQPVG

SEQ ID NO: 29085 - protein, 246 aa, Bacillus subtilis
MSVISMKQLLEAGVHFGHQTRRWNPKMKRYIFTERNGIYIIDLQKTVKKVEEAYNFTKNLAAEGGKILFVGTKKQAQDSVKEEAQRSGMYYVNQRWLGGTLTNFETIQKRIKRLKDIEKMQENGTFDVLPKKEVVQLKKELERLEKFLGGIKDMKDLPDALFIIDPRKERIAVAEARKLNIPIIGIVDTNCDPDEIDVVIPANDDAIRAVKLLTSKMADAILEAKQGEEEAEVAEETAPETETTTA

SEQ ID NO: 29086 - protein, 180 aa, Lactococcus lactis
MHPHLKEVLFTREQIAERVKELAEVVSRDYEGKNPLVVGILKGSIMFTVDLLKELSIDAEVDFMDVTSYGYGISSSGEVRILKDLSTVAHGRDILIVEDIIDTGNTLLYLKKLLTGRQAHSVKIISLLDKPSGRKVDIDADYVGFEVPDAFIVGYGIDYAERYRQLPYIGIFNEEFLIKD

SEQ ID NO: 29087 - protein, 322 aa, Streptomyces avermitilis
MPKTQSGTSNRTRSTTAGGSARGKWNAGDIPDQTGRTAVVTGANSGLGIATVEALARAGAHVVLAVRDLERGEAAAAGVHGSVEVRRLDLADLASVREFAAGWQGDLHLLINNAGVMNIPEASTKDGFEMQFGTNHLGHFALTNLLLPRIKDRVVTVSSGAHRMPGSPYIHFDNLNLTGEYAPLTAYSQSKLANLLFTLELQRRLAEAASPVRALAAHPGWAATNLQSHDGSALRRALMRVGNRFIAQDNRAGALPTLYAAVQDLPGASYVGPDGFGEMRGGPTLVGRSAAAGDPVSARRLWTASEDLTGVTFPRLTAAVSA

SEQ ID NO: 29088 - protein, 536 aa, Arabidopsis thaliana
MNAAVFSPSALSLPISFSKTRSSFLSRKKGVKGEFRVFAVFGDESGLVEKKSQWRPLFDVEDPRSKAPPYKGKFLDVNQAIEVARFDIQYLDWRARQDLLTIMILHDKVVDVLNPLAREYKSIGTVKKELAGLQEELSKAHQQVHISEARVSTALDKLAHMEELVNDRLLPGRVVTELDKPSSSTTASAVELDREKTNTGAKSLNVSGPVPPYSPHLKNFWYPVAFTADLKHDTMVPIECFEQPWVIFRGEDGKPGCVRNTCAHRACPLDLGTVNEGRIQCPYHGWEYSTDGECKKMPSTKLLKVKIKSLPCLEQEGMIWIWPGDEPPAPILPSLQPPSGFLIHAELVMDLPVEHGLLLDNLLDLAHAPFTHTSTFAKGWSVPSLVKFLTPTSGLQGYWDPYPIDMEFKPPCIVLSTIGISKPGKLEGKSTQQCATHFHQLHVCLPSSKNKTRLLCRMSLDFAPILKNLPFMEHLWRHFAEQVLNEDLRLVLGQQERMLNGANIWNLPVAYDKLGVRYRLWRNAVDRGDDKLPFSG

SEQ ID NO: 29089 - protein, 515 aa, Methylococcus capsulatus
MKVFCVHPSPLMYTKVFLRLEPLGLELVAESLRRAGHDIRLMDLQVESHADFLRELDTWRPDVVCFSLNYLANVPEVIDLAKTAKSRLPECFTFVGGHSASFVAKDLLDHGEGLLDCVLRGEGEAGAPKLLETLARRGNIDEVPGVVSLTGEGPPPGFTDNLDEHLPARDLLKYRRKYFLGTLDPCASIEFSRGCPWDCSFCSAWTFYGRSYRVMSTERIMEDLRRIKEPGIFIVDDVAFIQAQHGMEIGEAIAREGIRKQYYLETRGDVLLRNKEVFKLWKKLGMEYMFLGVEAIDAEGLQKFRKRVSLGKNFEALEFARSLGITVAINLIADPDWDRERFEVIRQWCMEIPEIVNISVNTPYPGTESWHTESRQLTTRDYRLFDIQHAVLPTRLPLPEFYGELVKTQQVLYKKHMGWAAARDTLKILGGHLLRGQTNFLRSLWKFNSVFNPELQLADHRQPVKYPMTLPPAPTEQKIEAKTLYVHRSQGRKSRALDDATEKFVDEGRMGAATG

SEQ ID NO: 29090 - protein, 513 aa, Lactococcus lactis
MINLKIGQKLQLEIERMGINGEGIGVISGRLVFIPYALPGEEVLVEITENARNFSRAKLVKIIEKSPNRVKPQDRAYHEMSQSHIMHLSYPMQLEFKRDVMRQALEKYKPAGWRNYELRATLGMENTLGYRNKLQFQVRRLNDGTVIAGLYQEGTHHLVNLDNCLVQDPKTQEIINHICRLIEKFDLPVYDERKIGGIRTVMVRRSQKTGEVQIIFVTSTPIILDGQVWPELREEPSKRQKNSFVKFDKMLSALTEEFEEIVTVAVNFHPRKTSEIYGERTQILFNEKETITEGVLDYEFELSPRAFYQLNSEQANVLYGEAVKALNPKKDDRVIDAYCGVGTIGFAVAKKVKSVHGMDITPESIFDARENAKRLGLKNCHYEIGKAERIIPNWNKSGHRATAMIVDPPRTGLDDALLETITKFPPEKMVYVSCNVSTLAKDLVVLANFYKVEYIQSVDMFPHTARTEAVVKLTKRDEPLKIVKFEHLEEERKAEAFAKGKKRGRRPQKYGKY

SEQ ID NO: 29091 - protein, 831 aa, Aquifex aeolicus
MKGVILAGGFGTRIQPLTNSIPKPMLPVANRPIMEHVVHRLKEAGIEEIVVLLYYQAEVIKNYFKDGSDFGVKITYVQPEADYGTAGAVKQAQNYLNETFIIVSGDVITDFNLSELIAFHKSKSSKFTLALYSVENPLQFGVVITNKEGKVLKFLEKPGWGEVFSDTVNTGIYVVEPEILNYIPEDKPFDFAMDLFPKLMKSGIDLWALKMRGYWRDIGNIDSYRDVHKDIFAGLVKIRIPGRIITTKEARIYVEEGTEIPENVSLKGTVILGKNVKVGEGSELKNCVIGNNTVIGRNVKLFDSVLWWNVSIDEESEIRNGVICNDVKIGKRVKAKEGVVIAEDCEVEDEVLFLKDVVVWPEKVIEKGSVVTKNIVCESKWEKGIFKGNKVIGRINVELTPDNATKLGMALGSVLPPKSTVILARDYHRASRTIKRSFLGGILSTGINVIDLHLSPLPVMRFTLTEDKKAVCGVYFSISQEFPGSVEICVFDENGLPIDTNFQKKIERVFFREAYRFETFTDLGLIKEKPYFSENYVTKLLSSIDGDSIKLSSNKVVYDALHSPISPFISEVLGKLEIENVILNALYDERKLSRISTYASSSEGNVSKVLKALSYDVGFVMEPSATKLKLVDDRGRTISGDRLLLVVLMLLDKSAEKQLRVYLPVWAPEVLDAILNNVIVERGKFTNLRKSFIEDFYMLADTDGSFTFTEFSYSPDALYASLKIMEMLTKLKVKVSEIYDSLPEYYFLHEVVSCSSEKKGTVLRKISEMAEGKEASFIEGVKIYEDYGNWVLVLPDSYKDLIHVYVQSTERERAEELIKNYMEIVRGICKK

SEQ ID NO: 29092 - protein, 810 aa, Fusobacterium nucleatum
MKKVLIVGGVAGGASTATRLRRLDENLEIVIFEKGEYVSFANCGLPYYIGDIIQNRESLLVQTPESLKARFNLDVRVNSEVVGVNGKDKKVKVKTKNGEEYEEIFDFLVLAPGAKPIFPAIKGIENKKIFTLRNINDMDKIKAEIKNHNVKKATVIGGGYVGIETAENLKYLGIDTTLIEAAPHILAPFDSEISNILEYELVNNGINLMISEKVVEFQEDGNEIIIKLESGKIVTTDMLILSIGVSPDTKFLQNSGINLGERGHILVNEKLETNIDGIYALGDSIIVKNYITNQDVAIPLAGPANRQGRIVAGNIVGRNEKYKGSLGTAIIKIFELTGASTGLNERSLKQLNIPYEKVYLHPNNHAAYYPGATAISIKALYNKENGQILGAQAVGISGVDKFIDVIATSIKFKATIDDLTELELAYAPPFLSAKSPANMLGFIGQNIEDNLLGQVFMEDLENYNEKETIILDVREKLELISGKLNNSINIPLSELRKRYTELPKDKEIWTYCAVGLRGYIASRFLTQKGYKVKNLAGGIKIEEKELIKMQEETFSNKENSDYNVDKEDEYLDLSGLSCPGPLVKIKEKIDKLQESKKLKVKVSDPGFYNDIQAWSKVTKNSLLSLDKKDGLTYATLQKGQASKVVVKEQENVIIEDNSNMTMVVFSGDLDKAIAAFIIANGALTMGKKVTMFFTFWGLSILKKKKLAKKSFIEKMFAMMLPKNSQDLPVSKMNFFGIGAKMIRSVMKKKNIMSLEELMKKAKDSGVNITACTMSMDVMGISKEELIDGINYGGVGQYLGETEKSNNNLFI

SEQ ID NO: 29093 - protein, 462 aa, Zea mays
  misc_feature (221)..(221): Xaa can be any naturally occurring amino acid
MEPRRISASPRPCSVRRVVARKRPRQEAVVSSVRKLQRREISSRRDRAFAMSAAQERFRNIHLQEEFDTHDPKENTLLLPYLRKRSKIIEIVAARDIVFALSQSGVCAAFSREANERICFLNGSPDEVIRSLFYNKNNDSLITVSVYGSENFSALRCRTTRIEYIRRGQPDAGFPLFESESLKWPGFVEFDDVNGKVLTYSAQDSTYKVFDLKNYTFTVFXVSDKNVHPFKISPGIMLLIYTLTNSSVPLKILSIEDGTVLKSFSHLLHRNKKVDFIEQFNEKLLVKQEGENLQILDVRNFQLTEVSRTEFMTPSAFIFLYELQLFLTFRNRSVAVWNFRGELVTSFEDHLLWHPDCNTNNIYITSDQDLIISYCKADSTDSSSEENAGSINISSILTGKCLAKINPGNSCKQKDPCKQKKAWRFQNTVSEALEDITALYYDEDRDEIYTGNRHGLVHVWSN

SEQ ID NO: 29094 - protein, 106 aa, Agrobacterium tumefaciens
MATVKVDAANFQSEVLESAEPVVVDFWAEWCGPCKMIAPSLEEISSELAGKVKVAKLNIDENPELAAQFGVRSIPTLAIFKGGEVADIKVGAAPKTALSAWISSAA

SEQ ID NO: 29095 - protein, 366 aa, Clostridium perfringens
MMQPIKKIAILTGGGDCPGLNAVIRAVTRTAILKYGYEVIGYKFGYRGLYNNDFVKLDLDSVSGILHRGGTILHSSNKDNLFDYQVEDENGKIVKKDVSDVGVENLKKEEVDALVVIGGDGTLTSARDFSRKGVNVIGVPKTIDNDLLATDVTFGFNTATEIATEALDRLHTTAESHHRIMLLEVMGRNAGWIALESGIAGSADVILLPEIPYDINKIVEKVKEREESGKQFTIIVVAEGAKPKDGEVVVSKIVDDSPDPVRLGGIANKLAMDLEGLIKNHEIRSTVLGHIQRGGNTSTYDRILSTKYGVKAVELINSNLFGNMVALKGNKVSYESLENVIGNTKNVDPEGELVNTAKSIGISFAD

SEQ ID NO: 29096 - protein, 574 aa, Crocosphaera watsonii
MMNKPRDVQVYPIASDTMAIRSRTWDRLKFEIEYGLKRGTTANSYLIQGDKIALIDPPGESFTEIFLKALQERIDPTTIDYLILGHINPNRGETIKALMKIAPQITIVCSNTGALLLPNILLPEFPPQLKVVKGEDILDLGKGHQLEFTPTPNPRYPAQMCTYDPKTEILYTDKLFGSHVCGDQIFDEGWQVYAEDRRYYFDCVIAPYAKQINNALEKLSRKPAKIYGTGHGPLVRYGLKELTVSYQQWLEAQKAQTLSVALVYASAYGNTATLAQAIARGITKAGVRVESINAEVAEADDIKEAINNCSGFIFGSPTLGGHAPTQIQTALGITLANADKGKLAGVFGSYGWSGEAIDLLENKFRDGGYQFGFDPIKVKFKPTQATLKTCEEAGTDFAQAVKKAQKRRQPRNSVNQSQTDRLQQALGRIVGSLSIVTCQEEELSGAMLASWISQATFNPPGFTVAVAKERAIESLLHQGSYFVLNILKEGDHLGLMKHFLRPFSPGQDRFDGLKTQVADNGCPILEDALAYLECKVGDRMECGDHWVIYAIVTKGEVLQDGVTAIHHRKSGSHY

SEQ ID NO: 29097 - protein, 254 aa, Arabidopsis thaliana
MGGEEEVVSVELPAPSSWKKLFYPNKVGSVKKTEVVFVAPTGEEISNRKQLEQYLKSHPGNPAIAEFDWTTSGTPRRSARISEKTKATPSPDKEPPKKRGRTKSPVSKKDAEGEKSEGGGEENSHVKDTEMNPPEGIAENENVTDKNGSGETERVNDAKENIVAEETPNAAPVQEEGESMKEKALDSVDDKSKETDKEKDTGSIEKNSVDVEKKTVEASDEKKNSEAETRNHEENGLTTEAEGKEKTAEGEATG

SEQ ID NO: 29098 - protein, 223 aa, Paracoccidioides brasiliensis
MARRPARCYRYCKNKPYPKSRFNRGVPDPKIRIFDLGRKKANVDEFPLCVHMVSNEYEQLSSEALEAARICANKYLVKIAGKEGFHLRVRAHPYHVVRINKMLSCAGADRLQTGMRGAFGKPNGTVARVNIGQILLSVRTRDAHRATAVEALRRSMYKFPGRQKIIVSKNWGFTPLRREEYVRLKQEGRVKIDGAYVQFLRNKGNIEENMKRFPEAYENLSQV

SEQ ID NO: 29099 - protein, 572 aa, Cryptococcus neoformans
MSIPYETEKDKSISGGSQGAMTPINGKSGNEVLVTPALGEKGGFEGSGGNPGEGTVHRTLKQRHMAMIALGGAIGTGLFVGSGSALATGGPVGFWLGYVFMGLMVYSMMVALGEMASLYPVAGAFTHYAARFVDPALGFATGINYWYSYAITIPTEIVAATIVISYWDATTNAAVYITVCFVSIIAINFLGARAYGEAEFWFSSIKIVTIVGLIILGIVLMCGGGPNHDAIGFRYWRNPGPFAQVTIENGAGVIPGRWGQFLAFWNVFVQAAFSFIGTEIIATTLGEAENPRKTVPRAIKQVFFRILFFYVMGTFVISVLVPYTEPDLLNGSGTAAASPFVIAINNAGIKALPSIVNAVLLIAAWSAGNSDLYAASRTLYALALERQLPRVFRRCTKRGLPIWCVTVTALFGAFAYLNTGGEAAEEAFNWLYNLSAITGILTWWAILLSYLRFYYGLKKQGISRDDFPYRAPLQPYLSWLGFIFFTLVTIFSGFTVFLKGNWDTSSFFATYITIPIFVGCWIGWKVVKKTKIVPLEHMDFTTGRRELDELEALDAERFKAETKYQKIISILF

SEQ ID NO: 29100 - protein, 302 aa, Lactococcus lactis
MMKFGMIGLGKMGMNLVKNAVDHEIEVVAYDLNTKAVEEAKDYSDKITAVSTIENLLTELPASKIVWLMLPAGTPTNSTIEMLSEKLSAGDILIDGGNSNYKDNLEQNKLLTEKGIKFFDVGTSGGMAGARQGGNFMIGGDDEKSWTIIEPIFKAISMEEGYLYTGKLGSGHYLKMIHNGIEYGMMQAIAEGFEILEESPFDYDYEAVAKLWNHGSVIRSWLMELAQEQFSKDPKLDQIIGHVQSSGEGKWTVEESLDLGVPAPVIALSLMMRQRSLQEDTMTGKVVAALRNGFGGHDVEQK

SEQ ID NO: 29101 - protein, 488 aa, Aspergillus oryzae
MTIEQRANLGRVNVELNKIKKISFKLSMTIMDSVAIIRNQLKERGVENHDLIQACYAFATEFGKRSSNVDPNRRAMNTARLVELSLDWVSFICDDCDAADRKTFKWAVSALEFAMAITSNRRVDEDAKRQALGRVLEGSNEADRSLAVLSSSATNVTLRWQQGQFIGGGTFGSVYAAINLDSNYLMAVKEIRLQDPQLIPKIAQQIRDEMGVLEVLDHPNIVSYHGIEVHRDKVYIFMEYCSGGSLASLLEHGRVEDETVIMVYALQLLEGLAYLHQAGIVHRDIKPENILLDHNGIIKYVDFGAAKIIARQGRTVVPMDAFASAGHKEAIVPKDAQIANQRGKNQKTMTGTPMYMSPEVIRGDSNKLIHRQGAVDIWSLGCVILEMATGRRPWSALDNEWAIMYNIAQGNQPQLPTHDQLSDMGIDFLRRCFECDPLKRPTAAELLQHEWIVSIRQQVVLEPPTPSSDHSGSISSSTSGSRQNSTYL

SEQ ID NO: 29102 - protein, 322 aa, Salmonella enterica
MGTTKHSKLLILGSGPAGYTAAVYAARANLQPVLITGMEKGGQLTTTTEVENWPGDPNDLTGPLLMERMHEHAAKFETEIIFDHINNVDLQNRPFRLTGDSAEYTCDALIIATGASARYLGLPSEEAFKGRGVSACATCDGFFYRNQKVAVIGGGNTAVEEALYLSNIASEVHLIHRRDGFRAEKILIKRLMDKVENGNIILHTNRTLEEVTGDQMGVTGLRLRDTQQSDNIETLDIAGLFVAIGHSPNTALFEGQLELENGYIKVQSGTHGNATQTSIPGVFAAGDVMDHIYRQAITSAGTGCMAALDAERYLDGLADASK

SEQ ID NO: 29103 - protein, 328 aa, Bordetella parapertussis
MGVILKIPAMSTPKHAKVLILGSGPAGYTAAVYAARANLSPALITGLAQGGQLMTTTEVDNWPADVQGVQGPDLMQRFLQHAERFNTEILFDHVAKVDLSRRPFTLTGDTGNLYTCDALIIATGASAKYLGLASEQAFMGRGVSGCATCDGFLYRNKDVVVIGGGNTAVEEALYLSNICRKVTLIHRRDKFRAEPILVDKLMDKVANGNMELKLFHTLDEVLGDDSGVTGVRIRSTETDATEDLDVAGCFVAIGHQPNTGIFEGQLEMKDGYIITKSGLSGMATMTSVPGVFAAGDVQDHVYRQAITSAGTGCMAALDAQRWLENAGQ

SEQ ID NO: 29104 - protein, 194 aa, Bacillus cereus
MRQSSQARETTETKIKLNLQLDESTNVSIQTGVGFFDHMLTLFARHGRFGLQVEAEGDVFVDAHHTVEDVGIVLGNCLKEALQNKEGINRYGSAYVPMDESLGFVAIDISGRSYCVFQGELTNPKLGDFDTELTEEFFRAVAHAANITLHARVLYGSNTHHKIEALFKAFGRALREAVEKNANITGVNSTKGML

SEQ ID NO: 29105 - protein, 300 aa, Unknown
  Mycobacterium sp. JLS
MTKWTTADIPSQSGRTAVVTGANTGLGLETAKALAARGAHVVLAVRDTEKGKRAADEIAAAHPEAAVSVQSLDLGSLRSVRAAAEALKADFPRIDLLINNAGVMYPPKQTTEDGFELTFGTNHLGHFALTGLLLENVLAAPNSRVVTVSSQGHRIRAAIHFDDLQWERSYSRVGAYGQSKLSNLLFTYELQRRLDTRDAIAVAAHPGVSNTELMRHLHLPSVFNPLVGVLTQSPTMGALPTLRAATDPTVRGGQYFGPSGLGEIRGYPELVTSSAQSRDVDLARRLWTVSEELTGVAFPL

SEQ ID NO: 29106 - protein, 363 aa, Prochlorococcus marinus
MIENPSQIVKEISDEKEIENSTIEENTSDTPKEEDLSFDHKDIPSADSSSSRRNNDLDTAGFTQEEFASLLGKYDYNFKPGDLVKGTVFALEPKGAMIDIGAKTAAFMPMQEVSINRVEGLSDVLQPSESREFFIMSEENEDGQLALSIRRIEYQRAWERVRQLQKEDATIYSEVFATNRGGALVRVEGLRGFIPGSHISARKIKEDLEGEYLPLKFLEVDEERNRLVLSHRRALVEKKMNRLEVGEVVIGSVKGIKPYGAFIDIGGVSGLLHISEISHEHIETPHNVLNVNDQMKVMIIDLDSERGRISLSTKALEPEPGDMLTDPQKVFNKAEEMAAKYKQMLLEQTDENEEQTVEIAESV

SEQ ID NO: 29107 - protein, 147 aa, Oryza sativa
MSFAIRSSEPESWFLIPSEKAAVAVAAHRLVVMDQRRSGSAHRPKRTHMAAAEDEHRRPGTSSRRRVAPTPTTQTQTQTAPGYFTVELVMAFVCVTASLVLLPLVLPPLPPPPSLLLVVPVCLLAVLVAMAFVPLDAQSNVVGSSCL

SEQ ID NO: 29108 - protein, 426 aa, Unknown
  Halobacterium sp. NRC-1
MRIDIGAALDATATPGVPPDALDRLDDRVAHAHDRITAGMDGDEFGYAALNLPRTVDVDAITAAADAVADADTLVTVGIGGSALGAATLVDALGDDDLDYHALDNVDPAHVTRLLDRIDLSTSAVHVVSRSGTTAETLANFLVVRDAMDDAGVDWTARTLVTTGDDGPLRALADTHDLPVLDAPRGVPGRFAALSTVALPAAAIAGVDVGELVAGAADGRAALAGSLEDCSAYAYGATAYALDQRGAGVNAMLPYAERLETFAEWFAQLWAESLGKDGVGQTPARALGATDQHSQLQLYRAGPRDKLVTMLRPASRPDCAIPEAELADIDYLTGGDLGALLDAEFEATAASLAASGVPTVRVEVPAVDARSVGRLLFDFEAACVLAGELYGVETFTQPAVEWGKNAARELLRGEDPLPETETHIVE

SEQ ID NO: 29109 - protein, 395 aa, Unknown
  Rhodococcus sp. RHA1
MTQQEWIERDFYADLGVPSTASAEDIKRAYRKLARQLHPDANPHDQAAGERFKAVSEAHAALSDPATRAEYDRTRQLYRSGAFRRAGTRSGAGGGGPAGGMGGFDLSDLFGGGSSSFTSGEAGFGDVFGDLFRRSGTRTTASRPRRGSDVEAQTRLPFRQAVTGVVLPLQVSGPTVCTSCHGSGARPGTQPRRCPSCGGAGTLTRNQGGFGFSESCDDCRGTGVIVDSPCTDCQGTGVGHRTRTINVRIPPGVTDGQRIRLPAHGEPGLRGAPSGDLYVTVGVDPDPVFGRDGDDLTVTVPVGFAELALGTTISVPTLDGRVSVKIPAGTPSGRTFRLQGRGVPLRGRAPGDLRVTVQVAVPAGLNQRAIDALRAYEKAEKAAGFDPRTTWPGRR

SEQ ID NO: 29110 - protein, 485 aa, Unknown
  Shewanella sp. ANA-3
MNLTVPLTAKDDAIEWALTHGMAFKETAYSARHAPFTLTPSLISKAHYQYLKGAVEPLGKLIHYVSEAHAFLVDAIQPITASDPFFAALLKAHQQLHGSAHSSTNSSGTPAPRMPLLIMRSDFMDDRDLGPKLVEFNGIAAGMGPFGQRAHQLHRYLQQQWSIQPKGELVENHAIEQLSVGIATATFKIKQEFEDSGPARFLMLVQENEDNVFDQHLLELALQQKGIQTLRRTLSELQGQLTTGAQQRLILEGVGTIDTVYLRTGYQFADYATIDINGNRDYQALMEIRVLLEQHRIALNATLGQQLATSKRMQMLLSTMDEQALTQFGLTQPEASMVKSLLGEMRPVTAQSPQLIAESPIETWVLKNQGEGGGHCIFGADILPKLAELEPAQYPVWSLMRRLHPRPRATQALVVRNGEIHIIDDLIPEIGMFSVHCDGIAAVNDKTHAESPSYAGYLIRSKSAKVTEGGVHSGQGVLDSLMFSD

SEQ ID NO: 29111 - protein, 472 aa, Escherichia coli
MTTHLVWFRQDLRLHDNLALAAACRNSSARVLALYIATPRQWATHNMSPRQAELINAQLNGLQIALAEKGIPLLFREVDDFVASVEIVKQVCAENSVTHLFYNYQYEVNERARDVEVERALRNVVCEGFDDSVILPPGAVMTGNHEMYKVFTPFKNAWLKRLREGMPECVAAPKVRSSGSIEPSPSITLNYPRQSFDTAHFPVEEKAAIAQLRQFCQNGAGEYEQQRDFPAVEGTSRLSASLATGGLSPRQCLHRLLAEQPQALDGGAGSVWLNELIWREFYRHLITYHPSLCKHRPFIAWTDRVQWQSNPAHLQAWQEGKTGYPIVDAAMRQLNSTGWMHNRLRMITASFLVKDLLIDWREGERYFMSQLIDGDLAANNGGWQWAASTGTDAAPYFRIFNPTTQGEKFDHEGEFIRQWLPELRDVPGKVVHEPWKWAQKAGVTLDYPQPIVEHKEARVQTLAAYEAARKGK

SEQ ID NO: 29112 - protein, 297 aa, Yarrowia lipolytica
MNYPSVSEQKHRVFIIYSAYLRVQFRESARLAVSVRNKNYNLVRADLHNILPQKNTTVFKDGTLAPLLIRLAWHSCATYDKYTRTGGSNGATMRYHLEASDEGNVGLEVARLSLEPIKRKHPWITYADLWILAGVVSIEACKGPSIKWRDGRVDYEDDLLVPPNGRLPLGGGDASHVRTIFSRMGFNDQETVALIGAHSLGRLHHHRSGFDGPWTSNPAKCDNEFYKLLLGNVWTLVDSPTGRKQYVNSTGQVMMPSDMSLIEDANFRFWVDQYAVSEELWRDHFALAFEKLTELGR

SEQ ID NO: 29113 - protein, 457 aa, Yersinia pestis
MEQQLQNSSLKRGLKNRHIQLIALGGAIGTGLFLGIAQTINMAGPSVILGYAIGGFIAFLIMRQLGEMVVEEPVAGSFSHFAYKYWGDFAGFLSGWNYWAMFILVGMAELTAVGIYIQYWWPEIPTWVSAAVFFIIINAINLVNVRLYGETEFWFAIIKVAAIIGMIVFGAYLLASGSGGPAASVTNLWAQGGFMPHGFRGLIMAMAVIMFSFGGLEMVGITAAEAEDPRNSIPKATNQVVYRILIFYIGSLTVLLSLFPWNNVVEGGSPFVMIFDALDSPWVATALNVVVLTAALSVYNSGVYCNSRMLFGLASQGNAPKLLTKLNKRGVPIRSIALSALATSAGVVINYIMPGKAFELLMALVVSTLVINWVMICLAHLKFRKAKVKEGVVPRFKALWYPYGNYLCLVFLALILVIMYLTEGIRISVLMMPVWIALLWCGFVLTRRKCPKTVTSL

SEQ ID NO: 29114 - protein, 607 aa, Brucella melitensis
MNAGKHEAEANAGQAQDAGHPREMTGAEMVIQALIDQGVESIFGYPGGAVLPIYDGLFQQDQIQHVLVRHEQGAGHAAEGYARSTGKVGVMLVTSGPGATNAVTPLQDALMDSIPLVCISGQVPTTLIGSDAFQECDTIGITRPCTKHNWLVKDVNDLSRVLHEAFHVASTGRPGPVVVDIPKDIQFAKGIYTPPETAPRTSYRPVLDGNAEAISEAVRLLANARKPVIYSGGGVINSGPAASRLLRELVEISNFPITSTLMGLGAYPASGKNWLGMLGMHGTYEANMTMHDCDVMLCVGARFDDRITGRLNAFSPNSKKIHIDIDPSSINKNVRVDVPIIGDVAHVLEDIVRQFRAFDRKPDRQALTEWWGQIDRWRARNSLAYTPNKDVIMPQYAIERLYELTRNRNTYITTEVGQHQMWAAQFFGFEQPNRWLTSGGLGTMGYGLPAALGVQIAHPDALVIDIAGDASIQMCIQEMSAAIQHNAPIKIFILNNQYMGMVRQWQQLLHGNRLSHSYTEAMPDFVKLAEAYGAHGIRCEKPGDLDAAIQEMIDIDKPVIFDCRVANLANCFPMIPSGKAHNEMLLPDEATDEAVANAIDAKGRALV

SEQ ID NO: 29115 - protein, 419 aa, Methylococcus capsulatus
MKPFIEPETLPSAIPSSGPDRRRFLKAGLAVTGAALTGGVRAAPPPWMTRPGAPLSNYGQPSPHERAVIRWVAANPDAPGNGISWTPLERLEGIITPSGLHFERHHNGVPQIDPAVHRLVVHGLVVKSSSFGIDDLLRYPQTSRQCFVECGGNGNAGWHLEPMQAPAGNVHGLASCSEWTGVPLATVLEECGLQPNAKWLIAEGADAAAMNVSIPLEKALDDALLALYQNGERLRPENGYPLRLILPGWEGVTNVKWLHRLQLAEQPAMARNETAKYTELLPSGQARQFSFVMEAKSLITRPSAGQSLPGPGLHPISGLAWSGRGAIRRVEVSADGGKTWQDAALDPPVLPKCFTRFRLPWRWDGSPAVLKSRATDETGYVQPERQTLIAERGRHGYFHYNAIVSWAVAADGSVSHVYA

SEQ ID NO: 29116 - protein, 411 aa, Unknown
  Halobacterium sp. NRC-1
MSRSPSLPDRPTLDVDPESTPAERLNALQDHYVDIVAVNGELQAQLDDVEARREELREEVNRLQRENETLKTASLYLATVEDLPEDGSAVIKQHGNNQEVLTELSPRLADTLEVGDRVAINDSFSVQRVLDDETDARAQAMEVDESPSVTYADIGGLDDQLREVREAVEDPLVNPEKFDAVGVEPPSGVLLHGPPGTGKTMLAKAVANQTDASFIKMAGSELVRKFIGEGSRLVRDLFELAEQKDPAIIFIDEIDAVAAKRTDSKTSGDAEVQRTMMQLLSEMDGFDERGDIRIIAATNRFDMLDSAILRPGRFDRLIEVPNPNPDARERILEIHAGEMNVADSVDFSDLAADTAEFSGAQLASLATEAGMFAIRDDRDEVHRQDFDDAYEKLVAEGDTESSGPRYPSYIQ

SEQ ID NO: 29117 - protein, 131 aa, Bordetella pertussis
MRLLHTMLRVGNLDKSIDFYTSVLGMRELRRKDYPDGRFTLAFVGYQDESEAAAIELTHNWDTEKYDLGTGYGHIAIEVDNAYEACDKVKEKGGKVTREAGPMKHGTTVIAFVEDPDGYKIEFIQKKGRND

SEQ ID NO: 29118 - protein, 199 aa, Capsicum chinense
VLLENYSLGKSLTQRQIVQLASKGEQRNAINIVLTASDVAVDGFCVNRCGTHGSSKGAIIKGKTYKFAYIWVGNSETLCPGYCAWPFPQPIYGPQSPPLGAPNNDVGVDGMVINLASLLAGTATNPFGNGYYQGEADAPLEAAFACPGVYAKGAYPGYAGDLLVDKTTGASYNAHGTNGRKYLVPALFDPFTSSCSTLV

SEQ ID NO: 29119 - protein, 183 aa, Capsicum chinense
EKNITCLTRLDHNRALGQVSERLSVQVSDVKNVIIWGNHSSTQYPDVNHATVTTPTGEKPVRELVADDAWLNGEFITTVQQRGAAIIKARKLSSALSAASSACDHIRDWVLGTPEGTFVSMGVYSDGSYNVPAGLIYSFPVTCKNGEWSIVQGLPIDEFSRKKLDLTAEELSEEKALAYSCLT

SEQ ID NO: 29120 - protein, 438 aa, Thermus thermophilus
MRVFIDEIARHVDQEVELRGWLYQRRSKGKIHFLILRDGTGFLQATVVQGEVPEAVFREADHLPQETALRVWGRVREDRRAPGGFELAVRDLQVVSRPQGEYPIGPKEHGIDFLMDHRHLWLRHRRPFAVMRIRDELERAIHEFFGERGFLRFDAPILTPSAVEGTTELFEVELFDGEKAYLSQSGQLYAEAGALAFAKVYTFGPTFRAERSKTRRHLLEFWMVEPEVAFMTHEENMALQEELVSFLVARVLERRSRELEMLGRDPKALEPAAEGHYPRLTYKEAVALVNRIAQEDPEVPPLPYGEDFGAPHEAALSRRFDRPVFVERYPARIKAFYMEPDPEDPELVLNDDLLAPEGYGEIIGGSQRIHDLELLRRKIQEFGLPEEVYDWYLDLRRFGSVPHSGFGLGLERTVAWICGLAHVREAIPFPRMYTRMRP

SEQ ID NO: 29121 - protein, 186 aa, Arabidopsis thaliana
  misc_feature (41)..(41): Xaa can be any naturally occurring amino acid
  misc_feature (141)..(141): Xaa can be any naturally occurring amino acid
MGRRPARCYRQIKGKPYPKSRYCRGVPDPKIRIYDVGMKRXFHLRIRVHPFHVLRINKMLSCAGADRLQTGMRGAFGKALGTCARVAIGQVLLSVRCKDAHGHHAQEALRRAKFKFPGRQKIIVSRKWGFTKFNRADFTKXLRQEKRVCPLIGVKRLRFPSPWPMGPFWAKPVPGPGKVPFLAQPH

SEQ ID NO: 29122 - protein, 309 aa, Unknown
  Synechococcus sp. RS9917
MGLNAAKALVDRGWRVVTANRDPVRAAQAAESLGLPSAQLHHLRIDLGDLDSVRAGVEALIGSLPGELDALVCNAAVYKPRLKEPERSPQGYEISMATNHFGHFLLIQLLMPTLQASSHPSRRVVILGTVTANSKELGGKIPIPAPADLGDLSGFEQGFQAPISMASGKPFKPGKAYKDSKLCNMITSQELHRRLHEPTGIVFSSLYPGCVADTPLFRDTPKAFQTIFPWFQKNITGGYVTQALAGERVAQVVADPDFGTSGVHWSWGNRQKKDGRQFSQELSDKATDPRTAQRVWDLSMQLVGVAAEA

SEQ ID NO: 29123 - protein, 97 aa, Zea mays
  misc_feature (62)..(62): Xaa can be any naturally occurring amino acid
MATPGEQPAEVVSDEMPAPDGRTKKLTPLTGGRSEIGFAPPTGEDIKKQRQLSQDLEEHPGXGPAVSEFEWGNWRIPQGGPVRISEEAPRYFDRPKR

SEQ ID NO: 29124 - protein, 480 aa, Crocosphaera watsonii
MTISFENLGLSDARVNKLQRLGFESPTEIQEKAIPLILESNDILGQSQTGTGKTAAYSLPILEQIDTKNPNVQTLILTPTRELAQQVAEALKDFSTERRLYILTVYGGQSIERQIRSLERGVQIVVGTPGRVIDLLERKKLVLDCLRWAVLDEADEMLSMGFIDDVKTILRKTPETRNTACFSATMPREIRDLVNQFLKSPVTVSVERKQAAPTHIDQHLYYVPRGWSKRKALQPILEMEDPESAIIFVRTKQTASELTTRLQEIGHSVDEYHGNLSQSQRERLVYRFRDGKIKLVVATDIAARGLDVENLSHVINYDLPDNSETYIHRIGRTGRAGKTGTAISLIEPVDRRMVRQIERKLRQKLETCKIPSRSQVEAKRIEKLQNEIKESLAGERMASFLPLVRELSDEYDPQAIAAAALQMIYDQDCPEWMKTDWEVPESAVPKPVIKRKGKYNPNNSKRHGNSNRGNRKKVIHPQTR

SEQ ID NO: 29125 - protein, 335 aa, Haemophilus influenzae
MITSQTPITVLGAGSYGTALAITFSRNGSPTHLWGHNPVHIAQMQTERQNYRFLPDVIFPEDLHLESNLAQAMEYSQDILIVVPSHAFGEILIKIKPHLKAHHRLIWATKGLERNTGRLLQTVVEEQLGTQYPLAVLSGPTFAKELAQGLPSAITLAANNEQFAREFQSRIHCSKGFRVYINSDMTGVQLGGAIKNVIAIGAGISDGMGFGANARTALITRGIAEITRLGISLGANTNTFMGMSGLGDLVLTCTDNQSRNRRFGLMLGKGLDAQMAMENIGQVVEGFYNTKEAYLLAQRQGVEMPITEQIYQMLFCGKSAQDVAISLLGRACKGE

SEQ ID NO: 29126 - protein, 387 aa, Clostridium perfringens
MAKRDYYEVLGLQKGASDDEIKRAFRKMAMKYHPDRNPGDKEAEENFKEVNEAYDVLKDPDKKAKYDQFGHAAFDGSGGFGGGGFGGFDAGGFDFSEMGGFGDIFESFFGGGFGGGSSRRRNAPQRGADLEYRLNITFEEAVFGCEKEISITRTENCETCNGTGAKAGTSPKTCPKCNGSGQIRVQRQTPLGSFVSTTTCDQCGGTGKVIEDPCPDCKGKGTVRKNRKITVKIPAGVDTGNIIPLRGQGEQGANNGPAGDLYIRVNVAPSKIFRREGSDIYYDYKISMAKAALGAEITVPTVDGNVKYKVPAGTQPGTKFRLKGKGVPYVNGGGRGNQYVHMVVEVPKHLNKEQEEALKAFMKASGESVDDIDEKDEGFFSKFKKKK

SEQ ID NO: 29127 - protein, 296 aa, Coprinopsis cinerea
MGAALSLVSQSLPPKSKFSVEDIPDLTGKVVIVTGANSVYLAGRSQEKVERAIQELKQETGKEGIFLHLDLGDLKSVKKAAEEFISKEKELHILFNNAGVMTPPIDMVTTQGYDLQFGTNVLGHFYLTKLLYSTLLSTVKSSPDWKPRVVHTASVASLFGELNFNTFKDGPARRKSFSVILYAQSKLGNVIIANEFAKRYGDQGVISCSCNPGNLKTELTRYTPSIATALMNAFVLYPAPYGALTQLWAGTSEEGLKMNGKYLVPWARYGTPNPLALDEKLGEDLWNWLEEQVQDV

SEQ ID NO: 29128 - protein, 141 aa, Arabidopsis thaliana
MLQLCSTFRPQLLLPCQFRFTNGVLIPQINYVASNSVVNIRPMIRCQRASGGRGGANRSKPAKPQVKEGSNKTVIEGLVTESLPNGMFRVDLENGDNILGYICGKIRKNFIRILPGDKVKVEMSVYDSTKGRIIFRMSSRD

SEQ ID NO: 29129 - protein, 506 aa, Lactococcus lactis
MSLSQTSRCRINFIRERILENSSNSTTETQVKRGLKSRHVSMIALGGTIGTGLFLTSGDVIHTAGPFGALTAYVLIGAMVYFLMTSLGEMATYLPTSGSFSDYGTRYVDPAFGFALGWNYWLNWAITVAVDLTAVALCIKFWLPDVPSWIFSLIALIIVFAINALSVKTFGETEYWLSAIKITVVVLFLIIGFLSIFGIMGGHIDVAKNLSVGNHGFVGGLGSFTTGGGILGVLLVAGFSFQGTELLGITAGEAENPEKSIPKAMNSIFWRILVFYILSIFVMAAIIPFTDPHLVGGNSAAQSPFTIVFERVGLSIAASIMNAVVLTSVVSAANSGMYASTRMLYSLAKDGGAPKIFSKTSKNGIPFIALLATTAIALLTFLTSIYGVSFFTFLVSASGLTGFIAWIGIAISHFRFRRAYVAQGKDVKKLPYHAKLFPFGPILALIMTVLVTLGQDPMLLFGKTWVQGVIMYAAIPLFFILYLGYKFKNKTKLIPLKEVDLSRHKD

SEQ ID NO: 29130 - protein, 164 aa, Arabidopsis thaliana
MASSFSSQAFFLLTLSMVLIPFSLAQAPMMAPSGSMSMPPMSSGGGSSVPPPVMSPMPMMTPPPMPMTPSPMPMTPPPMPMAPPPMPMASPPMMPMTPSTSPSPLTVPDMPSPPMPSGMESSPSPGPMPPAMAASPDSGAFNVRNNVVTLSCVVGVVAAHFLLV

SEQ ID NO: 29131 - protein, 440 aa, Burkholderia xenovorans
MLSHEDNETLVRVGPGTPTGQFMRLYWLPFLPSSDLTVDGQPQRVRLLGEDLIAFRDSEGRVGLVDHVCPHRGAPLVFGRNENCGLRCVYHGWQFGVDGQVIDTPAEPAESRLKDKVRIRSYPCRERNGIVWAYMGEADANALPPLPNLEWNMVPLENVHFSFRVQECNWLQAVEGEIDSAHAPILHGRIDSQGAINEWTAKRDLRPVFECQRREFGISIASRRVLDDSHHYWRVNQFLFPFYTLVPPQSKYPELSGHAWVPVDDENTLCLMFSYTPAAPLYEKTRKLFEDGHAGRETGHASAHAFAPRPVTQPYAKYWTRFNLESAFQFDYDAQTKTWFSGLPGLWVQDAACQSGVAPIYDRRKENLGISDTGVAMTRRLLLENVRKLASERVSPVRVDDPDLWMVRAVSLTLPAGAPWQSDGAEHMRARLGADFGYTP

SEQ ID NO: 29132 - protein, 125 aa, Glycine max
HPVVSTGGIPAPGKSQPLGTISAAPWGSALILPISYSYIAMMGSKGLTESSNTAIYECKLYGKSIGESYPVFFPSFPPPRGGGGVALPTGLKNPRSIKPQNVPHSLLPYGSHTPNISFSPHPPPL

SEQ ID NO: 29133 - protein, 114 aa, Triticum aestivum
  misc_feature (76)..(76): Xaa can be any naturally occurring amino acid
  misc_feature (89)..(89): Xaa can be any naturally occurring amino acid
VTMRRKDCIDGYLASFEKDGSNVFSEWVAKFQIKTVLVVGICTDFCVLDFVSSTLAARNIGRVPPLEDVVIYSRGXVATFDLPVQVPRXIKGALAIHRFLSSHGLYMAKSKGAK

SEQ ID NO: 29134 - protein, 548 aa, Cryptococcus neoformans
MSVHLEYDDKKDAAYDYTQQVAPADAVPSSSDVEDVEVKSGLKRNLKSRHMAMISLGGVIGTGLFLGTGSALANGGPLGLFLGYATMGSICYCVMICLGEMISFLPIPGGHIKLAERFVDPALAFTMGWNYWYNWVIILPAELSAAAVLINLWNDTINNALWISICLVVVVAINFLGFFGECEFWFASIKILTIVGLIILGIIITAGGGPDHTSIGFQYWRNPGPFVQYEGISGSLGRFLGYWAVLTQAAFSYIGTEIVAIAAGEAKNPRRNLPRAIKRVYIRILVFYLGGTFIIGLLVPSNDEGLALNSGNALASPFVIAIRRAGIPVLPSIINACLLTSAWSAASSDLYTSSRALYGLSITRQAPKIFSRTTRRGLPWVSISFCALFAALSYMSLQSTAGEVFGYFSNLTAAAGLMTWWGICFIYIRFEKGLRVQGIARSSLPYSSRLNYRASAAWYGIIMITIILFFSAWSVFLKDNWSTSTFVTNYLPLWLFPILWVGYKYIKKTHFVRASEMDFVSGLQAIEAECHDETPPSTILGKFWDFLM

SEQ ID NO: 29135 - protein, 573 aa, Zea mays
MASSISAPAPPAAPATAPASGRPKKPSQFNPSTGKTRTPVPARPMRAAAPKWNPLQRLAAAALDALEEGLVAGVLERAHPLPRTADPAVQIAGNYAPVGERPPTGELPVSGRVPACLDGVYVRNGANPLHAPRAGHHLFDGDGMLHAVRLRGGRAESYACRFTETARLRQERAIGRAVFPKAIGELHGHSGVARLLLFGARSLCGVLDASQGIGVANAGLVYHNNRLLAMSEDDLPYHVRVTADGDLETAGRYDFGGQLDTAMIAHPKLDPATGELFALSYNVVSKPFLKYFYFTADGRKSPDVEIPVDAPTMMHDFAVTENHAIIPDQQIVFKLQEMVLGGSPVVYDRNKTARFGVLPKRATDASRLRWVDVPDCFCFHLWNAWEDEATGEVVVIGSCMTPADAVFNESAAGEESFRSVLSEIRLDPRTGTSSRRAVLSDADQVNLEAGMVNRQLLGRRTRYAYLAIAEPWPKVSGFAKVDLEAGTVDKFIYGDGRYGGEPCFVPRPDAPAGAAEDDGYVLCYVHDEARGASEMLVVNARDMRAEAAVKLPGRVPYGLHGTFIAGKELQRQA

SEQ ID NO: 29136 - protein, 569 aa, Coprinopsis cinerea
MENPLIPFGRAWWKEAVVYQIYPISFFDSNGDGIGDLNGIASKLDYLKDLGVDVLWLSPIYKSPLADMGYDISDYQDIDPRYGTLEDWDNLLKGVHDRGMKLIMDLVVNHSSDQHEWFLQSKSSKSNPKRDWYIWRPPKYDSSGNRQPPNNWKAVFQGSAWEFDETTQEYYLHLYLPQQPDLNWDNPEMDVINIISKTDGLPDAPIIAPGEPYQPAGTLFANGPRVHEYIKEMNTKVLSKYDILTVGETPFTHDASHLARYVLPANKELNMVFQFEHMELDTPLMGDDDVPLLYKSWKLTQMKEIITRWQQYKRDEGFWNAAYTENHDHARSVSRFGNDSDQWRALSAKLLGMLQVMQGGTQFVYQGQELGLKNFPRSWGLEEYKDIATQNFWSKTLNQRKASSDGPVDMEDVLDNFAKKARDHARVPMQWDLSPNAGFTRGTPWMRVNEDYQTWNAQSQTGDDTSVFAFWKRLLKLRKGNQTLIYGTFEDVSEGSEKVFGFVRALGDSWYYVVLNFGEEEITFTPKDGQGRAWSALKVVLGNYDEAPTLKANDGTAHLRGWEAVCYEA

SEQ ID NO: 29137 - protein, 229 aa, Brassica napus
  misc_feature (189)..(189): Xaa can be any naturally occurring amino acid
  misc_feature (197)..(197): Xaa can be any naturally occurring amino acid
  misc_feature (205)..(205): Xaa can be any naturally occurring amino acid
MTESSISSVKLPSPPEEETHHHQEDEETHRTNNKKRARPDPGYRGVRMRTWGKWVSEIREPRKKSRIWLGTFSTAEMAARAHDAAALTIKGPSAVLNFPELATFLPRPASSSPRDVQAAAAVAAAMDFSSSSSSAVVISDPTTVVPESQLSSSSSYSSFTSSSSLSPSSEEAASSTVEELSEIVELPSXDNEPWSEXVYVDPGYXPSSPWFSNIINACRVNISSIELFI

SEQ ID NO: 29138 - protein, 170 aa, Glycine max
  misc_feature (13)..(13): Xaa can be any naturally occurring amino acid
  misc_feature (38)..(38): Xaa can be any naturally occurring amino acid
AAAPKKTWIPAVXCGGSLIYPKWLDGSLPEDYGFDPLXLGKDPVFLKRYRQSELIHGRRAMAALVGIFIGQAWSGVPWLDAGAYPNAIAPISLGSLLCTHLLLMWWVESKTWVDFFNPDSQSVDCATPWSRTAHIFGNTTVEQGFPGRKFSDPLRFAGAIIDGVIMLHAH

SEQ ID NO: 29139 - protein, 291 aa, Thermotoga maritima
MMERLIGSTPIVRLDSIDSRIFLKLEKNNPGGSVKDRPALFMILDAEKRGLLKNGIVEPTSGNMGIAIAMIGAKRGHRVILTMPETMSVERRKVLKMLGAELVLTPGELGMKGAVEKALEISRETGAHMLNQFENPYNVYSHQFTTGPEILKQMDYQIDAFVAGVGTGGTISGVGRVLKGFFGNGVKIVAVEPAKSPVLSGGQPGKHAIQGIGAGFVPKILDRSVIDEVITVEDEEAYEMARYLAKKEGLLVGISSGANVAAALKVAQKLGPDARVVTVAPDHAERYLSIL

SEQ ID NO: 29140 - protein, 528 aa, Pseudomonas putida
MASVHGTTYELLRRQGIDTVFGNPGANELPFLKDFPEDFRYILALQEACVVGIADGYAQASRKPAFINLHSAAGTGNAMGALSNAWNSHSPLIVTAGQQTRAMIGVEALLTNVDAANLPRPLVKWSYEPASAAEVPHAMSRAIHMASMAPQGPVYLSVPYDDWDKDADPQSHHLFDRHVSSSVRLNDQDLDILVKALNSASNPAIVLGPDVDAANANADCVMLAERLKAPVWVAPSAPRCPFPTRHPCFRGLMPAGIAAISQLLEGHDVVLVIGAPVFRYHQYDPGQYLKPGTRLISVTCDPLEAARAPMGDAIVADIGAMASALANLVEESSRQLPTAAPEPAKVDQDAGRLHPETVFDTLNDMAPENAIYLNESTSTTAQMWQRLNMRNPGSYYFCAAGGLGFALPAAIGVQLAEPERQVIAVIGDGSANYSISALWTAAQYNIPTIFVIMNNGTYGALRWFAGVLEAENVPGLDVPGIDFRALAKGYGVQALKADNLEQLKGSLQEALSAKGPVLIEVSTVSPVK

SEQ ID NO: 29141 - protein, 244 aa, Oryza sativa
MSSTNNSSGEPPPAVRVLGGWASPFTNRVVVALKLKGVEHEMLQETVGKKSELLLRSNPVHKKFPVLLHHSKPLPESLVIVEYIDEVWPASNGGAPAILPRDPHGRAVERFWARYVDDKILPGLRVLRGSVAGDKDQTAGEMSTTLQRLEEAFVKCSQGKEYFGGDSIGYLDIALGSFLGWIKAVEKIAGVELLNETKLPILAVWADRFCAHPAVVDVVPDADKLVEFTVQYGSVLNTVNVLPK

SEQ ID NO: 29142 - protein, 113 aa, Geobacter sulfurreducens
MKEIKAIIRPGKLRDVAEELHAIDGMPGVTVSEIKGFGKGKARNATDKILYEMVEFIPRVKLEVVVADDMVDDVVNVIQKYAHTGNTGDGKIFISTIDDVVKIRTNERGSSAI

SEQ ID NO: 29143 - protein, 227 aa, Rickettsia rickettsii
MTNNLSGYRNKFVRVKTSKKRTVSSSNWLRRQLNDPYVAKARIDGFRSRAAYKLLEIHEKFKLFTPNMKVVDLGAAPGGWSQVASKLIKASDNNLNNKIISIDVLEIEHVAGVEFVQKDFFEADTEELIIQALDGRADIVMSDMASNTIGHKATDHIRTLLLCEQAFEFALKVLKPSGHFIAKIFRGGAENELLHKVKREFKTVKHFKPSSSRSESTEIYLVALNKK

SEQ ID NO: 29144 - protein, 274 aa, Nostoc punctiforme
MGSSKSEYTENLSYKKTLYAIEPSVYIVGAGPGDPDLLTVKAQKLLAVADVILFADSLIPEQILELCRKDAEIIRTANQTLEEILPIMIDRVRSQQKSLVRLHSGDPSLYSAIHEQMHLLAEANIPFEVIPGISAFQAAAAKLKVELTVPGLVQTIILTRISGRTEVPANEELASLAAHQASLCLYLSARHVENAQAKLLEHYPAETPIAICFRIGWPDEKIKVVPLNEMAECTHKEKLIRTTLYIISPALSTAKGRSRLYHPEHSHLFRSSHN

SEQ ID NO: 29145 - protein, 489 aa, Vibrio vulnificus
MSAELLLNVTPSETRVAMIEGGVLQEVHIEREARRGIVGNIYKGKVSRVLPGMQAAFVDIGLDKAAFLHASDIVPHTECVAENEKQQFQVRDISELVRQGQDIVVQVVKDPLGTKGARLTTDITLPSRYLVFMPGASHVGVSQRIESESERERLKKIVSHYCDEHGGFIIRTAAEGADGKELSQDAAFLKRLWLKVMERRSKYKTRSTLYGELGLAQRILRDFVGTELDKILVDSRQEFENLKEFTSEYVPELTDKLELYEGDKPIFDMYDTENEIQRSLERKVELKSGGYLIIDQTEAMTTVDINTGAFVGRRNLEETIFNTNIEATQAIARQLRLRNLGGIIIIDFIDMSSEEHRKRVLTSLENALSKDRVKTNINGFTQLGLVEMTRKRTRESIEHILCSSCPTCEGRGSVKTVETVCYEILREITRVNRAYDADKFVVYASPAVADALHGDESHALAELEVFIGKQVRIQAEPLYIQEQFDVVMM

SEQ ID NO: 29146 - protein, 975 aa, Burkholderia vietnamiensis
MKHEHPDRLMNRTPLSLAALETHDAFAERHIGPDAASQQAMLDTLGFASRAALIDAVIPASIRRAEALPLGPFAQPKSEAEALAALRALADKNQVFRSYIGQGYYDSHTPAVILRNVLENPAWYTAYTPYQPEISQGRLEALLNFQQMVVDLTGLAISNASLLDEATAAAEAMTLLQRTGKPKSNVFYVADDVLPQTLEVVRTRALPIGIEVKTGPAAEAAQAGAFGVLLQYPGVNGDVRDYRALTDAIHAAGGHVVVAADLLALTVLTPPGEWGADVAVGNTQRFGVPMGFGGPHAAYMAVRDEFKRQMPGRLVGVTVDAQGKPALRLALQTREQHIRREKATSNVCTAQALLAIMASMYAVYHGPHGLKTIALRVNRIAALLAAGVKQLGFTTVNDTFFDTLTIDAGARTAQLHAFANAKRINLRRVSDTQVGVSVDETTTRDDLADLLAVFAQAAGGTAPDVDALDAGLPGVAALPAGLERTSAYLTHHVFNRHHSETEMLRYLRSLSDKDLALDRSMIPLGSCTMKLNATSEMLPVTWPEFGRIHPFAPSEQTAGYREMIDQLEQMLVAATGYAAVSLQPNAGSQGEYAGLLVIHAYHASRGEAHRDVCLIPASAHGTNPASAHMAGMKVVVVACDAQGNVDIADLKAKAEQHANDLAAIMITYPSTHGVFEQNVREICEIVHAHGGQVYVDGANMNAMVGLTAPGQFGGDVSHLNLHKTFCIPHGGGGPGVGPVAVGPHLAKFLPNQRSTGYARGEEGIGAVSAAPYGSASILPISWMYIAMMGAKNLTAATETAILNANYIAKRLAPHYPVLYSGPGGLVAHECILDLRPIKETSGITVDDVAKRLMDYGFHAPTMSFPVPGTLMVEPTESESQEELDRFIAAMIAIREEIRAVEEGRADREDNPLRHAPHTAAVVTANEWPHAYSREQAAYPVASLVTNKYWPPVGRADNAYGDRNLFCSCVPMSEYA

SEQ ID NO: 29147 - protein, 321 aa, Thermotoga maritima
MWFAVLSSNEVRRKPVGVRRLGRDLVFWRDSLGKVYALEDFCVHRRARLSAGKVINDRIQCPFHGFEYDGNGRVRLIPALGKNYKVPDRFRVNSYPVYEKNNIIWLWSGEGEPEKEPKFFDDIDEDFAYAEFRELWNVPFPRAVENQLDVMHLPFVHRTTIGRGNRTLVHGPVVKWIDEDSFIFYVFNEVDRGQRVKRPEELSGEESRVYLEFIFPNLWQNHISEGTRVVAFFVPVDRQKTMIYLRFYVKMTGLKPVDSIIARLSMPLNRIILHQDRRVVETQERDIRKDVLVQGDLPIMEFRKRLYKEKKLIDFLFGGGQ

SEQ ID NO: 29148 - protein, 135 aa, Escherichia coli
MRLLHTMLRVGDLQRSIDFYTNVLGMKLLRTSENPEYKYSLAFVGYGPETEEAVIELTYNWGVDKYELGTAYGHIALSVDNAAEACEKIRQNGGNVTREAGPVKGGTTVIAFVEDPDGYKIELIEEKDAGRGLGN

SEQ ID NO: 29149 - protein, 101 aa, Oryza sativa
  misc_feature (53)..(53): Xaa can be any naturally occurring amino acid
  misc_feature (76)..(76): Xaa can be any naturally occurring amino acid
  misc_feature (96)..(96): Xaa can be any naturally occurring amino acid
MGAMGTTGSSLLKTSFAGARLPAAARNPTVSVAPRTGGAICKSISSSSSNPPXDLNAIRFSPIKESIVSREMTRRXMTDMINYADSDVVVVGAGSXGLSCA

SEQ ID NO: 29150 - protein, 273 aa, Prochlorococcus marinus
MTDFLAAALQLTSTSEPELNFAAAEEQIELAARRGAELVGLPENFAFMGDDERRLELAQDLAQQCSRFLVTMARRYQVVLLGGGFPVPAGDSNHTVNRAELVGRDGQLLARYDKIHLFDVDLPEGNTYQESATTTSGRELPPVVDVPGLCRVGLSICYDVRFPELYRHLVGAGAELLMIPAAFTAFTGKDHWQVLLQARAIENTSYVLAPAQTGRHYSRRQSHGHAMVIDPWGTVLADAGVSQGAAIAPVDNSHIGRIRAQMPSLQHRQAALF

SEQ ID NO: 29151 - protein, 582 aa, Magnetospirillum magnetotacticum
MCGLAALFSYRADAPPPDAAELARMTGAMTRRGPDGEGVWSGAEGRVRLGHRRLSIIELGEPGAQPMIADDGKTAIVFNGEIYNYRALRLRLEQQGVRLRSHSDTEVILEGYRLLGPDILAQLRGMFALAIWDGERGGILAARDGLGIKPLYVADDGRTVRLASQVKALLAGGGIETAPDPAGHAGFFLWGHVPEPHTLYRSIRALKPGTWERWGLDGRRDSGAFFDLGAELRRPRQAPRADLKSALEDSVAHHLVADVPVGVFLSAGRDSTTLAAMAAKLGTGKVKSVTLAFEEFAGTPKDEAPLAELAARHYATEHITRRIPGGDFAACRDQILADMDQPTIDGVNVWFVARAARESGLKVALSGLGGDELFAGYDNFTTIPRIVSVLGPSGAIPGLGRGFRALAGHFVRPKLAGLLELGTTLPDAYLLRRGLFMPWELPQVMDADMARIGLEALAPRLHLKRAAAGLGDDVAAISALEMQFYMRNQLLRDADWAGMAHSLEIRVPLVDTHLLDAVLDLRAAGRTPGKADMAACADPGLPTAILERPKTGFFVPVAQWLGESSLRGWAKRVHAALCEETL

SEQ ID NO: 29152 - protein, 72 aa, Unknown
  Photobacterium sp. SKA34
MAKEDVIEMAGTVLDTLPNTMFRVELENGHVVTAHISGKMRKNYIRILTGDKVTVELTPYDLTKGRIVFRAR

SEQ ID NO: 29153 - protein, 320 aa, Cucumis melo
LLAPSVVKVFVAPLLDLSMDIELYTGKPWYSSKEIFPAAVKFLYPRDWDYARFRAIAGKCGALLLCDMAHISGLVAAQEAANPFEYCDVVTATTHKSLRGPRAGMIFYRKGPKPPKKGQPEDAVYDYEDKINFSVFPALQGGPHNHQIGALAVALKQAMSPGFKAYAKQVKANAVALGNYLMNKGYKLVTGGTENHLVLWDLRPLGLTGNKVEKLCDLCNITVNKNAVFGDSSALTPGGVRIGAPAMTSRGLVEKDFEQIAEFLHRAVTITLNIQKEYGKLLKDFNKGLVNNKEIEELKADVEKFSGSFDMPGFLMSEMK

SEQ ID NO: 29154 - protein, 140 aa, Xanthobacter autotrophicus
MRFLHTMVRVTDIDQSLDFYCNKLGLKEVRRKEVPQGRYTLVFLAAPGQADVAEIELTYNWDPEPYGEGRNFGHLAFEVEDIYATCERLMAGGVTINRPPRDGYMAFVRSPDNVSVELLQKGGPKAPAEPWASMANTGKW

SEQ ID NO: 29155 - protein, 705 aa, Bacillus subtilis
MGQEKHVFTIDWAGRTLTVETGQLAKQANGAVMIRYGDTAVLSTATASKEPKPLDFFPLTVNYEERLYAVGKIPGGFIKREGRPSEKAVLASRLIDRPIRPLFADGFRNEVQVISIVMSVDQNCSSEMAAMFGSSLALSVSDIPFEGPIAGVTVGRIDDQFIINPTVDQLEKSDINLVVAGTKDAINMVEAGADEVPEEIMLEAIMFGHEEIKRLIAFQEEIVAAVGKEKSEIKLFEIDEELNEKVKALAEEDLLKAIQVHEKHAREDAINEVKNAVVAKFEDEEHDEDTIKQVKQILSKLVKNEVRRLITEEKVRPDGRGVDQIRPLSSEVGLLPRTHGSGLFTRGQTQALSVCTLGALGDVQILDGLGVEESKRFMHHYNFPQFSVGETGPMRGPGRREIGHGALGERALEPVIPSEKDFPYTVRLVSEVLESNGSTSQASICASTLAMMDAGVPIKAPVAGIAMGLVKSGEHYTVLTDIQGMEDALGDMDFKVAGTEKGVTALQMDIKIEGLSREILEEALQQAKKGRMEILNSMLATLSESRKELSRYAPKILTMTINPDKIRDVIGPSGKQINKIIEETGVKIDIEQDGTIFISSTDESGNQKAKKIIEDLVREVEVGQLYLGKVKRIEKFGAFVEIFSGKDGLVHISELALERVGKVEDVVKIGDEILVKVTEIDKQGRVNLSRKAVLREEKEKEEQQS

SEQ ID NO: 29156 - protein, 722 aa, Saccharophagus degradans
MQWGTPSQKDKKVNPVIKKFQYGNDTVTLETGRIARQASGAVLASMGQTSVLVAVTGSKEAKPGQDFFPLSVHYQEKAYAAGKIPGGFFKREARPSEKETLTSRLIDRPIRPLFPNGFLNEVQVVCTVISAEKDVDPDIVAMIGTSAALAISGIPFNGPIGAARVGYTQESGYLLNPTYSTLKTSELDMVVAGTADAVLMVESEAKELPEDIMLGAVLYAHQEMQAVVQAVAELAKDAAKPVWDWKPEEVNAELKAKVEHGFADSVGVAYRITDKQKRYDRLSELRNQAVAELATEESGVSADEVKGLFAKIEKQIVRSRVVAGEPRIDGRDSKTVRPLHVEVGVLPKVHGSALFTRGETQALVVSTLGSARDAQIIDALEGERKDPFMLHYNFPPYSVGECGRMGATGRREIGHGRLARRGIGAVLPKEEDFPYTMRVVSEITESNGSSSMASVCGASLALMDAGVPLKAPVAGIAMGLVKEDNGFAVLTDILGDEDHLGDMDFKVAGTADGVTALQMDIKIEGITEEIMEIALGQAMDARLHILAEMNRVIASPRKELSENAPQFHTMKIDPDKIRDIIGKGGATIRSITEETGASIDIDDNGTIKIYADDGDGMQAAIARIEEITAEAEIGAVYQGKVVRIVDFGAFVNFLPGKDGLVHISQIAHERVQNVSDYLKEGQDIEVKCMDIDQRGRIKLSIKELLPAPEAETAEAPAGEGEE

SEQ ID NO: 29157 - protein, 883 aa, Arabidopsis thaliana; identical to SEQ ID NO: 508

SEQ ID NO: 29158 - protein, 863 aa, Aspergillus nidulans
MYAQRPLAYAPTPYSYTPNTTRSASINLDEEVKLASSSAERDLYESLAEIYSIIVTLDGLEKAYIKDVVTEAEYTETCTRLLKQYKSSLGDDTVARAFVDLETFKRTWDLECPRATERLRIGMPATVEQASHSGPSTNKAPGTTGSAGGTSGSLILTATENFITFLDALKLNMVSKDALHPLLSEVIQSVNKVTDADFENRGKIIQWLITLNQMRATEELSEEQARELSFDIESAYQGFKSTLDVDLSPLNMITAEPEKPLHVLDLPQIYTKPSGTELLQTLDLLRIKPRNFGVSPHESVKRQTVESTGLTRYLTSIIASPLSWLDTDELREAIWDAAAARLSERSGRTAMPAMSRVFAVPTSSGEELTLTLHEPSLTADNLGMKTWVSSYLLSRRLHTILDSTSQLVPSTSTGPTLNSDRTLRALELGAGTGLVGLSFAALRGNSAKIHLTDLPEIVPNLAYNAALNVELLNRTAATVTTGVLDWSDSPAMLPTAEEQYDLILAADPLYSPEHPRLLADTVAIWLSRGLDARVVLEMPLRDAYLPQVQELRQRLGRVGLAVVQEGEETGYDDWETANGDAVANNINTVIVNLNLRSLSEALPFCLYIFCSYTYTNNIIGRFDPTIHLGPPTNKQAEYRYNKMVIGLLAITAIPTVTGIALGCSEQRKQNARQDDEKRMAKFYTDVVCTEDVEEADELDEKRVVLRNNKVYIDDPNPAKRKVESHTGQAFYIDYPEPDHMKDLKRGLGLVSTIQDNPPMLNWIYCDKETHELKYGNRTQSCEHVPAPWDWTDNEMTIILERNWGFYAVKEKDAEGRWSWAVYLDRDGDDLQRVLGDDVVAVPVKLKRTLVGTVPADSNQTGGS

SEQ ID NO: 29159 - protein, 107 aa, Haemophilus influenzae
MSEVLHINDADFESVVVNSDIPVLLDFWAPWCGPCKMIAPVLDELAPEFAGKVKIVKMNVDDNQATPAQFGVRSIPTLLLIKNGQVVATQVGALPKTQLANFINQHI

SEQ ID NO: 29160 - protein, 104 aa, Staphylococcus epidermidis
MAIVKVTDSDFDSKIESGVKLVDFWATWCGPCKMIAPVLEELAGDYDGKADILKLDVDENPSTAAKYEVMSIPTLIVFKDGEPVDKVVGFQPKENLAEVLDKHL

SEQ ID NO: 29161 - protein, 198 aa, Agrobacterium tumefaciens
MAERKGEIIRKTNETSVSVRVDIDGTGKSKISTGVGFFDHMLDQLSRHSLIDMDIEVQGDLHIDDHHTVEDTGIAIGQAIAKALGDRRGITRYASLDLAMDETMTKAAVDISGRPFLVWNVNFSAPKIGTFDTELVREFFQALAQNAGITLHILNHYGANNHHIAETCFKAVARVLRTATEIDPRQAGRVPSTKGMLA

SEQ ID NO: 29162 - protein, 177 aa, Glycine max
  misc_feature (26)..(26): Xaa can be any naturally occurring amino acid
  misc_feature (60)..(60): Xaa can be any naturally occurring amino acid
  misc_feature (62)..(62): Xaa can be any naturally occurring amino acid
  misc_feature (106)..(106): Xaa can be any naturally occurring amino acid
  misc_feature (118)..(118): Xaa can be any naturally occurring amino acid
MEAETAAKRARRRGRCGGGWSREQGXISRVIPGWVSEISPMWPGEAHSLKVKKVLFQASXTXQDVLVFQSLTYGKVLVLDGGIQVTERDECPYQEMITPPPLCSIXKDPRKALVIGGXENGAFCGKVPRHSSVGANPPLGKRTRWGAMGPKNFFPHLPLGFKDPPGAPEHGERGPPS

SEQ ID NO: 29163 - protein, 259 aa, Bacillus cereus
MMGKVYIVGAGPGDPDLITVKGLKCIEKADVILYDRLVNKELLSYAKPDADLIYCGKLPNYHTMKQETINTFLIKYAKKGKVVTRLKGGDPFVFGRGGEEAEALAKQGVPFEIIPGISAGIAAPAYAGIPVTHRDASASFAIVTGHRKEGAEEEVKWESLAKGVETLAVYMGVSNLPYICEQLMKHGKDKSTPAAIIEQGTTSMQRTVVGTLGTIVDVAKKEQIQNPSMIVIGEVVRFREKIHWFEKQTENAYQVSGVL

SEQ ID NO: 29164 - protein, 289 aa, Unknown
  Frankia sp. CcI3
MAVVTMKQLLESGVHFGHQTKRWNPKMKRYIFTERNGIYIIDLQQTLSYIDRAYDFVKETVAHGGTVLFIGTKKQAQEAIEEHAARVGMPYVKERWLGGMLTNFSTVYKRLQRLKELEEIEVTGGTEVRTKKEQLVLTREKVKLERTLGGIRDMSRVPSAVWVVDTKKEHIAVGEARKLGIPVVAILDTNCDPDEVDYPIPGNDDAIRSAALLTRVVADAVADGLMARAGASSSADAKPEQSAGEEPLAEWEQALLRGEAPAEAPGAVEPATAEPADGTRPDAAVGTAV

SEQ ID NO: 29165 - protein, 612 aa, Unknown
  Mycobacterium sp. JLS
MTQTLADPREPTTDLTPQQRVDAWLADFEAALAVRDIERVVAKFATDSFWRDLVAFTWNIKTLEGRDGIADMLTARLTETDPARFRTREAPTVDGDVTTAFIEFETGVGRGVGHLRLRGDECWTLLTTMQEIKGHEERKGPSRVLGAVHGSDPDPRSWAEKRAEEDAALGRTVQPYALVIGGGQGGIALGARLRQLGVPAIVVDRHERPGDQWRKRYKSLCLHDPVWYDHLPYLPFPQNWPVFAPKDKIGDWLEFYTRVMEVPYWSKTTCLSAVFNPGSDGAPDTWTVEVDRDGERLTLRPTQLILATGMSGKPSVPTLPGQDVFRGEQHHSSAHPGPDRYVGKRAVVIGSNNSAHDICKALVENGVDTTMVQRSSTHIVKSDSLMDLGLGDLYSERALAAGMTTEKADLTFASLPYRIMHEFQTPIYDAIRERDKDFYERLTAAGFELDWGDDGSGLFMKYLRRGSGYYIDVGACDLVADGTIKLAHGQVSHLTEDTVVLADGTELPADVVVYATGYGSMNGWAADLIGQDVADKVGKVWGLGSSTTKDPGPWEGEQRNMWKPTQQENLWFHGGNLHQSRHYSLYLALQLKARFEGIPTPVYGLQEVHHLS

SEQ ID NO: 29166 - protein, 449 aa, Streptococcus agalactiae
MTSGKTYVASVLEKVKKQNEHEEEFLQAVEEVFESLVPVFDKYPQYIEENLLERLVEPERVISFRVPWVDDKGQVQVNRGYRVQFSSAIGPYKGGLRFHPTVTQSIVKFLGFEQIFKNSLTGLPIGGGKGGSNFDPKGKSDNEVMRFTQSFMTELQKYIGPDLDVPAGDIGVGGREIGYLYGQYKRLNGYQNGVLTGKGLTYGGSLARTEATGYGAVYFAKEMLAARGQDLTGKVALVSGSGNVAIYATEKLQELGATVVAVSDSSGYVYDPDGIDLETLKQIKEVERARIVKYTEKHPKANFTPADQGSIWSIKADLAFPCATQNELDEEDAKLLVENGVLAVTEGANMPSTLGAIKVFQKAGVAFGPAKAANAGGVAVSALEMAQNSSRRAWTFEEVDQELQRIMKTIFVNASEAADEFGDSGNLVLGANIAGFLKVAQAMSAQGIV

SEQ ID NO: 29167 - protein, 470 aa, Vibrio angustum
MDYLPIFADLKRRPCLVVGGGDSAWRKTRMLLKAGADVRVIAPSLNADFTAALASQQIKLVGEHFSPSDLDGIFLAIAATERKAINALVYQSANQRQVLVNVVDDTQRCSFIIPSIVDRSPIIVAISSSGQAPVLARLLREKLEALLPQHLGRMATIAGNFRQRLSQTVSSFSARRYFWEQAFNGRFGDLVASGREQEAEQELVALTQQAPPQGQVALIGAGPGDAGLLTLRALQLMQQADVVLYDYLVSDEVMDLVRRDAELVCVGKKAGFHSVPQEETNRLIVHYAQQGKRVVRLKGGDPFVFGRGGEELEVLFDADIPFQVVPGITAAAGATAYAGIPLTHRDYAQTAMFVTGHLKPDGDTLDWSTLARGKQTLVIYMGLMKSSHIQQQLLEHGRGADTPIAIIERGTQKTQKVLKGQLSELAELAKHAASPSLIVVGEVVNLSTKLDWFTKQEQSLQQQDAVVKLA

SEQ ID NO: 29168 - protein, 843 aa, Clostridium difficile
MSLKSLKIKENLYWVGSLDPDLRVFDIIMYTPYGTTYNSYVLKGTEKTVLFETVKDKHFDNYIERLNDLNIDFEKIDYIVVSHTEPDHAGSVEKLLDLAKNAKVVASETAIKYLKEIVNKDFEYVAVTDGDTLSIGDKTLEFFSVPMLHWPDTIYTYIKEDKTLVTCDSFGSHYSNDKIVNTLDENEEKDYLDALRYYYDCIMGPFKPSMVTAIEKIKDLDIDTVCPGHGPVLTENPRKIIDLYYNWSVNEQIKLEKEVTICYVSAHGYTKIMAEAIKAYIEKNSNYKVNLFDVIEHKQEDILAKIAVSQGVLFGTPTILGDALKPIWDILISLNPVLHGGKVASVFGSYGWSGEGIENAMERISQLRMTAVKPFAVNFKPSNEEIDKLHSYTGKFLDKLNSTFGSKKKTKKFKCVICNEVFEGDSAPSVCPVCGAKEDQFIEVEEDEVTFRKDTDEYFVIVGNGAAGFYAADAIRKRNKTCKITMISNEDELTYYRPALSDGINEELGSDFYMEDKDWYDKNNIVVILGTNVDKLDEVNKTIIVNDGAIKFDKLVIATGSRNFIPPIKGHDLENVFTLRNIKDLYSVKEALEKSKKVVVIGGGLLGLEAAWEFRLKGLEVVVVEAMDSILSKQLDKEGSKILEQCVRDTGIDVRLGVAVDGIEGDVKAQKVVFKDGDSVDCDMVVFSIGVRANTQMVQDTSVKIDRGIVVDKTLQTNVKDIYACGDVAQVGNISLAIWPSSVEMGKIAGANASGDNLTFESEVYPVSLDAMNVKVFSIGNIQNFDKEISSKDEGQRIYKKLFMKDGSLVGAILINDLSCTVKLIRLISEKGDFEDIMKADIL

SEQ ID NO: 29169 - protein, 291 aa, Oryza sativa
  misc_feature (15)..(15): Xaa can be any naturally occurring amino acid
  misc_feature (230)..(230): Xaa can be any naturally occurring amino acid
MASSVAAAASTFLGXRLADPAPQSGRIVARFGFGGGKKAAAKKAARPSAPTTDRPLWFPGAVAPDYLDGSLVGDYGFDPFGLGKPAEYLQFELDSLDQNLAKNNAGEIIGTRFETGEVKSTPFQPYTEVFGLQRFRECELIHGRWAMLATLGALSVEWLTGVTWQDAGKVELVDGSSYLGQPLPFSISTLIWIEVLVIGYIEFQRNAELDPEKRLYPGGSYFDPLGLASXPEKKERLQLAEIKHARLAMVAFLGFAVQAARHRPRGPSTSWATHLSDPLHTTIFDTFSSSS

SEQ ID NO: 29170 - protein, 324 aa, Robiginitalea biformata
MHKIAVLTSGGDSPGMNAAIRSVVRTCAYMNVECMAIYRGYQGMIEGDFVAMNARSVNNIINKGGTILKSARCEDFKTPEGRKKAHEQLVQAGISGFVVIGGDGSFTGATIFNKEYDFPVIGIPGTIDNDIFGTRYTLGFDTALNTVVDAIDKIRDTASSHNRLFFVEVMGRDVGHIALNAGVAAGAEEILIPEENLGLDRLLESLRRSKKTGKSSSIVVVAEGDKTGKNVFELKEYVEEHLPIYDVRVSVLGHMQRGGPPSAFDRVLASRMGVKAVEALIAGKTNLMVGIIDNEIVLTPIAEAIKGHTKIDRELVRVSDIMTI

SEQ ID NO: 29171 - protein, 442 aa, Solanum lycopersicum
MAVAEFIPSSSSLTKKASFYSSQLSNVSTKISHQRRLSFKPLLRTHNHSQICCSVTSKEAQATTVVQTDDPKKKSECYGVFCLTYDLKAEEETSSWKKMITVSVSGAAGMIANHLLFKLASGEVFGPDQPIALRLLGSERSIQALEGVAMELEDSLYPLLREVNIGIDPYEVFQDAEWALLIGAKPRGPGMERAGLLDINGQIFAEQGKALNAVASRNVKVIVVGNPCNTNALICLKNAPNIPAKNFHALTRLDENRAKCQLALKAGVFYDKVSNVTIWGNHSTTQVPDFLNAKINGLPVKEVIKDTKWLEEEFTEKVQKRGGVLIQKWGRSSAASTAVSIVDAIRSLVTPTPEGDWFSTGVYTNGNPYGIAQDIVFSMPCRSKGDGDYELVKEVIFDDYLWNRIKKSEDELLAEKRCVAHLTGEGIAVCDLPGDTMLPGEM

SEQ ID NO: 29172 - protein, 316 aa, Unknown
  Photobacterium sp. SKA34
MSNVKHCELLILGSGPAGYTAAVYAARANLNPVMITGMQQGGQLTTTTEVENWPGDAEDLTGPALMDRMKAHAEKFNTEIITDYIVETDFSQRPFLLKGESNTYTCNALIISTGASAKYIGLESEEAFKGRGVSACATCDGFFYRNQKVAVVGGGNTAVEEALYLSNIASEVHLIHRRDSFRSEKILIDRLMDKVANGNIILHTDRTLDEVLGDDMGVTGLRLKDTHSNATEELEVMGVFIAIGHQPNTAIFEGQLDMENGYIKVQSGLNGNATQTSIEGIFAAGDVMDHNYRQAITSAGTGCMAALDAERYLDAQ

SEQ ID NO: 29173 - protein, 201 aa, Glycine max
MPAKMRIMRKMLVSDQTDTYTNSDNNTTHKFDDQKQQLSSPLGTDNSSSNNYSNHSNNTVRVCSDCHTTKTPLWRSGPRGPKSLCNACGIRQRKARRAMAAAAASASGNGTVIVEAKKSVKGRNKLQKKKEKKTRTEGAAQMKKKRKLGVGSAKASQSRNKFGFEDLTLRLRKNLAMHQVFPQDKKEAAILLMALSYGLVH

SEQ ID NO: 29174 - protein, 97 aa, Glycine max
RYCKNKPYPKSRFCRGVPDAKIRIFDLGRKKAKVDEFPLCGHMVSDEYEQLSSEALEAARICANKYMVKSCGKDGFHIRVRLHPFHVIRINKMLSCA

SEQ ID NO: 29175 - protein, 412 aa, Methanosarcina barkeri
MSYIEKTDPELFEAIKKEAERQEYKLNLIASENYASKAVMEAQGSILTNKYAEGYSGKRYYGGCDFVDIAEDLAIARAKKIFNAGYVNVQPHSGSGANMAVYFSVLKPGDTIMSMDLSHGGHLSHGSPVSFSGKLFNIVPYGVSKKTEMLDYSELMKKAKENKPQMIVCGASAYPREIDFKQFREIADEVGAYLLADIAHIAGLVVAGVHPSPVPYADFVTSTTHKTLRGPRGGIIISKTEELATRINKAVFPGLQGGPLMHIIAGKAVAFKEAMSEKFKQDQVQTVKNAKTLCKCLKEKGFDMVSGDTDNHLMLVNLNNMNITGKDAEAALSKAGIIANKNTVPFETRSPFITSGVRLGTPACTTRGMKETEMELIADYIETAITNSENDKILSETSDKVRELCSRFPVYC

SEQ ID NO: 29176 - protein, 643 aa, Nicotiana tabacum
MKMKSMNDDNNNCSSHRSSNNNNNNNSNSHNDASSNWLGFSLSPHMKMEVTSSEPQHQHHQFNNQSSALAQSFYLSSSPMNVTSNTSALCYGVGENNPFGHSSLSVMPLKSDGSLCIMEALSRSHADAMVQSSSSPKLEDFLGGASQYGNHEREAMALSLDSLYYHQNEGYYSPMHCHGMYQESLLDETKPTQISHCDAQMTAVSGNELKSWGHYAIDQHINETCSSMVGAGGGGGTSGSGGGTVGGNDLQSLSLSMNPGSQSSCVTPRQISPNELECVAIETKKRASGKVVQKQPVHRKSIDTFGQRTSQYRGVTRHRWTGRYEAHLWDNSCKKEGQTRKGRQVYLGGYDMEEKAARAYDLAALKYWGPSTHINFPLENYQKELEDMKNMTRQEYVAHLRRKSSGFSRGASMYRGVTRHHQHGRWQARIGRVAGNKDLYLGTFSTQEEAAEAYDVAAIKFRGVNAVTNFDISRYDVEKIMASNTLPAGELARRNKEREPIEYNLSDHKNEEACVQNDNNNNNGNNVTDWKMVSYQSSNPSLGNYRNPTFSMALQDLIGIDLMNSSNHPILDDQQNKIGNHFSNASSLVTSLGSSREASPDKSAASLVFAKPTNVNACIPSAQLRPIPVSISHLPVFAALNDA

SEQ ID NO: 29177 - protein, 947 aa, Pneumocystis carinii
MILKILLTLTLYWIYLVRVRCETVPVDFENNDYYYYFHLLEDVDIEEFSRAIGFKYHMKVEYLDNHHIFFIEKGVLEDEIKEKIENYFGLEKGRNAIDGFNSDKLFYYEKQKLVKQENRGAIRDDIYFDNQDLYNDEVVNNVEVVNNVVKDPTGDDQAGKSTEDQVENSTEDQAGKSTGDLPGNPPVNLTQKLEEIKKQLNISDPWIRGKNVTVAIADNGIDYCNQDLAPNYNANASYNFDAGNSDPKPEKLDESHGTKCAGEVAAAKNTLCGLGVAYESKISGIRFLTSYLALVLEKDAVSYKPDLNHIYSCSWGPPDNGELAMPMMPTTYSAVIKGIKEGRNGLGSIYVFGSGNGGLLDDCNYDGYANSPYTVTIGAIDSEDKNFYFSESCPCILASTYSGGENESIYTTDIGKTNCTTEHSGTSASTAIAAGIIALVLSVNPNLTWHDIQALIVETAVPFNLKYPGWGELPSKRYYNNYFGYGKLDAYRMVERARTFKTLNAQTMFSTQLIRINMQFPGTTKHITSSFYIHSGYPEYYNFKNLEYVGVSFHYQHQRKGRLEFSITSPANVTSKLARVRIRDKEGGTFSWVFTTVKHWGESIVGNWTIDVEDKNMWNEQSSIFSWQLHFFGESINSSKAQPPPYPFAHKQPTTAPPPDPGATPPPDLDANPQPQPDPGSPPSSDPESPPSSEPGYQPPSKPGPQPPSEPQPPSKPDLNPPSDPSSQQDPDTSLSSNPTSTSSSEPSPPSPPPAPAPAPPAPPPPPAPAPAPPAPPPPPAPAPAPPAPPPPPAPAPAPPAPPPPPAPAPAPAPPPPPPPPPPRPELEPEPEPEPEPEPEPQPPQPQPEPPVPPPKPQPPPPPPEQKPTSITSSTSTTSSSKTKISTTRKASSTKTSSTTKTSARPSPTEGTFTGSSASHLSFFEKRHLLLQMILLLFFFLFLGYSF

SEQ ID NO: 29178 - protein, 473 aa, Streptomyces avermitilis
MAAVTAAGAAQAPIVAGHPLLGSMNDLLNDPLATYLRARRDHGDVVRFRAGPPGLRADIYAVFSAEGAQQVLATESGNFRKDNVFYGELRDSVGNGLLTSQDATYLRQRRLVQPLFTRRRVDGYAGQVADEAAGLAEAWRGIPGGGVELVGEMHRFALRVVGRILFGTDMETTFEVIERTLPLLQEYALKRGLAPVRTPRTWPTPANRRAARTQAELFALCDGIIDSRRNRKNEGDGGEESGEDLVTLLVRAGNAEDGSLDAAELREQVLIFLLAGHETTATALAFALHLLARHPEQQRRVRDEADRVLGGPGGRAPTAADMEALPYLTMVLKEAMRLYPSAPVIGRRAVADAEVDGVRIPAGADLFVSPWVTHRHPDYWPDPERFDPERFTPEAEAGRPRYAWFPFGGGPRACIGQHLSMLESVLGLAVLIREFEFEAVGEEEVPLGAGITLLAKGPARCRVIPRSSGPRSS

SEQ ID NO: 29179 - protein, 136 aa, Mycobacterium tuberculosis
MGLLSRLRKREPISIYDKIGGHEAIEVVVEDFFVRVLADDQLSAFFSGTNMSRLKGKQVEFFAAALGGPEPYTGAPMKQVHQGRGITMHHFSLVAGHLADALTAAGVPSETITEILGVIAPLAVDVTSGESTTAPV

SEQ ID NO: 29180 - protein, 136 aa, Mycobacterium tuberculosis
MGLLSRLRKREPISIYDKIGGHEAIEVVVEDFYVRVLADDQLSAFFSGTNMSRLKGKVVEFFAAALGGPEPYTGAPMKQVHQGRGITMHHFSLVAGHLADALTAAGVPSETITEILGVIAPLAVDVTSGESTTAPV

SEQ ID NO: 29181 - protein, 471 aa, Pichia angusta
MSLDTEVDKIVSEFAVTQETLQKGVERFIELATAGLNSDEDKYGLPMIPTFVTSIPTGKEKGILFAADLGGTNFRVCSVALNGDHTFKLIQQKSHIPAELMTSTSDELFSYLASKVKNFLETHHEGAVTSTGSQKFKMGFTFSFPVSQTALNAGTLLRWTKGFNIPDTVGQEVVSLFQMHLDAQEIPVTVSALSNDTVGTLLARSYTGSNKEGTTVLGCIFGTGTNGAYNEKLENIKKLPAEVREKLKAQGVTHMVINTEWGSFDNQLKVLPNTKYDAQVDELTGNKGFHMFEKRVSGMFLGEILRHILVDLHSKGVLFTQYASYESLPHRLRTPWDLDSEVLSLIEIDESTNLQATELSLKQALRLPTTTEERLAIQKLTRAVAKRSAYLAAIPIAAILHMTESFKGHNVEVDVGADGSVVEFYPGFRTMMRDAIAQTQIGAKGERRLHINIAKDGSSVGAALCALSEKD

SEQ ID NO: 29182 - protein, 136 aa, Mycobacterium tuberculosis
MGLLSRLRKREPISIYDKIGGHEAIEVVVEDFFVRVLADDQLSAFFSGTNMSRLKGKVVEFFAAALGGPEPYTGAPMKQVHQGRGITMHHFSLVAGHLADALTAAGVPSETITEILGVIAPLAVDVTSGESTTAPV

SEQ ID NO: 29183 - protein, 112 aa, Unknown
  Silicibacter sp. TM1040
MKLIIAAIKPFKLEEVREALTKLGVSGLMVTEIKGFGAQAGHTEIYRGAEYEVNFVPKVKLEIVVPSDLADQVVETITQASRTGKIGDGKIFVLDVAQAVRVRTGETNQDAL

SEQ ID NO: 29184 - protein, 136 aa, Mycobacterium tuberculosis
MGLLSRLRKREPISIYDKIGGHEAIEVVVEDFYVRVLADDQLSAFFSGTNMSRLKGKAVEFFAAALGGPEPYTGAPMKQVHQGRGITMHHFSLVAGHLADALTAAGVPSETITEILGVIAPLAVDVTSGESTTAPV

SEQ ID NO: 29185 - protein, 302 aa, Clostridium perfringens
MKYYNDIRDLIGNTPILKLNNISTKEGVNIYAKIEGTSPGGSCKDRVGIYMIEKAEKEGKLKPGSTIIEATAGNTGIGIALAAINKGYKIIFIVPDKFSIEKQKIMKALGAEIINTPKEEGMEGAINLANSLLSEIPNSLSLNQFKNEANPLAHYETTGRELYDGLDGQIDYFVAGAGSGGTISGVLKFLKENISEVKGILADPVGSIIGGGQCGTYKIEGIGNNFIPETMDMSLVDDVIKINDEEAFDAVKLLAKKEGLIVGSSSGAAFAAALKLAEKIDKGNIVTIFPDRGDRYFSTDLF

SEQ ID NO: 29186 - protein, 557 aa, Nostoc punctiforme
MANLTDFKLFAPRNKGAALIGSFSDWKEIPMSKSEDGYFRTKIKLEDGVYQYKFRIQTKSPNFAPDEWIDVIDPKATEVNETEKYGIVRIQDGQRIVDSYFWQHDEMPLPDNRELVIYEMHVADFTGDEVDSNERGKYLGIIAKLDYLCELGINAIELMPVNEYPGDYSWGYKVRHFFATESSYGSTEDLKRLIDECHGRGIRVFMDGIYNHTDEECPLILIDRNYWYYEHKHYPEDPANYWGPEFNYDFYDKNLNIQPAWEYIGDVVRFWIQEYHIDGIRFDAVRQLANFEFLNWLTKQAKNHAAPKQFYNIAEHIPDTNTVVKPDGPLDACWHESFRYFLVPYICGKSFELEQLKQILDPKQQGYAIATNVINYLATHDRERLLRELGNCGIFDAAAFERAKLAAVLLMTAMGIPMLWMAEEFGEYQQKSEDVTKPQKITWSLLLDDQNYDLFEYYQKLITLRQQTPALQSDNIKFFYENADDKVLAYSRWDEQNSHVVVVVNFSDRSLNQYKISDFPTTEDWRDWVGNREVKSGEDGLVTDLPSYTAKIFVLQT

SEQ ID NO: 29187 - protein, 230 aa, Zea mays
  misc_feature (79)..(79): Xaa can be any naturally occurring amino acid
PATVLDTPIHSASPWPRSRGTSSCAPPPPPPPPRHNAGGGPCRPTPQRARTGSSPPRAGWRWLRPRRWRPRPRPRCPRXPPAPPPPAMAAEAAAVPAPATPPGPGAAVGHPRRTCASGTSSPELTAEEAAARIRQTAEGMRTLRPMLETMSWKYVLFYVRLKSKYLGLDLTTAMAGVPVARRADYVGVANELVDNMTELDRFVRTPKVYESYLFYEKTLKSLDDVAEFLV

SEQ ID NO: 29188 - protein, 425 aa, Unknown
  Sulfitobacter sp. EE-36
MTLDMTQTDDIPALMADIGARAKAAAATLGFASADQKQTALEKAADALMASSADILDANAKDLEFGRDKGLSDAMMDRLLLDDARISAIADSLRSIAAQDDPVGQVLTEWDQPTGLNIQRVRTPLGVIGVIYESRPNVTADAGALCLKAGNAVILRGGSESFHSSRAIHAALQQGLEAADLPADSIQLVPTRDRAAVSEMLTMTDTIDVIVPRGGKGLVGLVQREARVPVFAHLEGIVHIYIDENADPEKVLKVVLNAKTRRTGICGSAECLLIHEKVARTIGKGVIKALLDAGVEVRADGALTEIEGTVPATADDWGHEYLDMIIAAKTVGSIDDAITHIRTYGSNHTDCIITEDDAAATKFMTRLDSAILMHNASTQFADGGEFGMGAEIGIATGKMHARGPVGAEQLTSFKYLVRGDGAVRS

SEQ ID NO: 29189 - protein, 557 aa, Salmonella enterica
MTESFAQLFEESLKEIETRPGSIVRGVVVAIDKDVVLVDAGLKSESAIPAEQFKNAQGELEIQVGDEVDVALDAVEDGFGETLLSREKAKRHEAWITLEKAYEDAETVTGVINGKVKGGFTVELNGIRAFLPGSLVDVRPVRDTLHLEGKELEFKVIKLDQKRNNVVVSRRAVIESENSAERDQLLENLQEGMEVKGIVKNLTDYGAFVDLGGVDGLLHITDMAWKRVKHPSEIVNVGDEINVKVLKFDRERTRVSLGLKQLGEDPWVAIAKRYPEGTKLTGRVTNLTDYGCFVEIEEGVEGLVHVSEMDWTNKNIHPSKVVNVGDVVEVMVLDIDEERRRISLGLKQCKSNPWQQFAETHNKGDRVEGKIKSITDFGIFIGLDGGIDGLVHLSDISWNVAGEEAVREYKKGDEIAAVVLQVDAERERISLGVKQLAEDPFNNWVALNKKGAIVTGKVTAVDAKGATVELADGVEGYLRASEASRDRVEDATLVLSVGDDVEAKFTGVDRKNRAISLSVRAKDEADEKDAIATVNKQEDANFSNNAMAEAFKAAKGE

SEQ ID NO: 29190 - protein, 485 aa, Taxus cuspidata
MDALKQLEVSPSILFVTLAVMAGIILFFRSKRHSSVKLPPGNLGFPLVGETLQFVRSLGSSTPQQFIEERMSKFGDVFKTSIIGHPTVVLCGPAGNRLVLSNENKLVQMSWPSSMMKLIGEDCLGGKTGEQHRIVRAALTRFLGPQALQNHFAKMSSGIQRHINEKWKGKDEATVLPLVKDLVFSVASRLFFGITEEHLQEQLHNLLEVILVGSFSVPLNIPGFSYHKAIQARATLADIMTHLIEKRRNELRAGTASENQDLLSVLLTFTDERGNSLADKEILDNFSMLLHGSYDSTNSPLTMLIKVLASHPESYEKVAQEQFGILSTKMEGEEIAWKDLKEMKYSWQVVQETLRMYPPIFGTFRKAITDIHYNGYTIPKGWKLLWTTYSTQTKEEYFKDADQFKPSRFEEEGKHVTPYTYLPFGGGMRVCPGWEFAKMETLLFLHHFVKAFSGLKAIDPNEKLSGKPLPPLPVNGLPIKLYSRS

SEQ ID NO: 29191 - protein, 403 aa, Oryza sativa
  misc_feature (266)..(266): Xaa can be any naturally occurring amino acid
MASLAQHVAGLASPPLSGAPRRRPAAPTRPSALVCGTYALTKEERERERMCQLFDEASERCRTAPMEGVSFSPEDLDSAVESTDIDTDIGSLIKGTVFMTTSNGAYVDIQSKSTAFLPLDEACLLDVNHIEEAGIRAGLVEEFMIIDENPGDETLILSLQAIQQDLAWERCRQLQAEDVVVTGKVIGGNKGGVVALVEGLKGFVPFSQVSSKSTAEELLDKELPLKFVEVDEEQGRLVLSNRKAMADSQAQLGIGSVVLGTVESLXNPYGAFIDIGGINGLLHVSQISHDRVADISTVLQPGDTLKVMILSHDRERGRVSLSTKKLEPTPGDMIRNPKLVFEKADEMAQIFRQRIAQAEAMARADMLRFQPESGLTLSSEGILGPLSSDTPSEGSGEGQTTDE

SEQ ID NO: 29192 - protein, 289 aa, Unknown
  Sulfitobacter sp. EE-36
MALPEFSMRQLLEAGVHFGHQTQRWNPRMGPFIYGARNGIHIMDLTQTVPMLDQALQVIRDTVAKGGSILFVGTKRQAAQPIAEAAEKCAQYYMNHRWLGGTLTNWQTVSKSIQRLKSIDEQSERGFSGLTKKERLGMERDQAKLEASLGGIREMGGRPDLIFVIDVKKEALAVAEANKLGIPVIAVVDTNCSPDGIDYIIPGNDDAARAIHMYCDLAARAALDGMSAQLGAAGVDIGAMEEAPEEEALIDGGVEVGNASEETVSNDAMAKDAPLDIESKKETLADAKS

SEQ ID NO: 29193 - protein, 339 aa, Hordeum vulgare
MENILHATPAPVSLPESFVFASDKVPPATKAVVSLPIIDLSCGRDEVRRSILEAGKELGFFQVVNHGVSKQVMRDMEGMCEQFFHLPAADKASLYSEERHKPNRLFSGATYDTGGEKYWRDCLRLACPFPVDDSINEWPDTPKGLRDVIEKFTSQTRDVGKELLRLLCEGMGIRADYFEGDLSGGNVILNINHYPSCPNPDKALGQPPHCDRNLITLLLPGAVNGLEVSYKGDWIKVDPAPNAFVVNFGQQLEVVTNGLLKSIEHRAMTNSALARTSVATFIMPTQECLIGPAKEFLSKENPPCYRTTMFRDFMRIYNVVKLGSSLNLTTNLKNVQKEI

SEQ ID NO: 29194 - protein, 149 aa, Brassica napus
GIFTPDYNHLCKKVLPFSIFANNEVHSYKSSQDQWERLHVLEKCCVDSLNLLPYKLHNVCLNSVMHDQIVSGIDWSSKSNKIVTVSHDRNSYVWNLEGDEWIPTLIILRLSRAAFCVRWSPKVMLNMPFDCLENRLQVFTFKWFLAAED

SEQ ID NO: 29195 - protein, 330 aa, Myxococcus xanthus
MNEATGSKHAEQWAAHWYAVARSPALGTGRPLGIQRLGRRLVLWRDAAGEAHCADAACPHRGADLGLGRVRQGALECPYHGFRYGGGGACLAMPCEGPDAKPSRGLALRMHPVREAHGFIWAWLGGRAPASLPALPWLADAPEPDSSSAAVEEVWNARFTRVMEGMMDLHHFPFAHRRYVPPGYTRLDPYEVHVDAGAIRTVGWLRKETRPPGTGFRFAIDVGYPGVLHLRFTPRLVAAVVCTPVDAEHTWIAARFHQQYVRLPGLRWLAARLAIAFEFRFIQPDDYRMVRSSLPRSGALTHGTLIRADRAIVAWHELHRAALGDTPGAS

SEQ ID NO: 29196 - protein, 1141 aa, Phaeosphaeria nodorum
MAGTEPIITQGIEPSSGESHSPPGERHVSATWGSKDGNISNAEWNDPEANKLPEKVAELEKKGEINQDGQRKKIVVVGLGMVGIAFIEKLMKYDVKRREYDVVVIGEEPHLAYNRVGLTSFFQHRLVENLYLNPKEWYSSMPEGSLNYHLNTMVTEIDSYNKTVKTSSGDTVPYDILVLATGSDALLPRHTPGHDAKGVFVYRTIEDLQNLIEFASSRKGTTGAVVGGGLLGLEAAKAMMDLEDFGQVRLIERNRWVLSRQLDGDAGGMVVEQVRALGLDVMLSKRVGKILTTEENAVKGVVFEDGEEMECSCISFAIGIKSRDELARKSGIKCADRGGGIVVGSDLTTSKPDIYAIGECASWENQTFGLIAPGVEQADVLAFNLTQAKAHAPRKFKSPDLSTKLKLLGVEVASFGDFFADRDGPKNMPGRQRAEKKEAGGINVKALTYKDPFQQVYKKYLFTMDGKYLLGGMMIGDTKDYVKLVPMVKNQKPLDMPPSELIIGASKGDDDGSDLTDDTQICSCHNVTKGDVVNSVKDGTCKSIGDVKSCTKAGTGCGGCMPLVQTIFNKTMASMGNEVKNHVCPHFEHSRADLFNIIYVKELKDFSAVMKACGKEPESLGCEACKPTIGSIIASLYNKHLLDLDRRGLQETNDRFLANIQRNGTFSVVPRVSGGEITPEKLIVIGMVAKKYNLYTKITGGQRIDMFGAKKHQLPEIWQELIDGGMESGHAYAKSLRTVKSCVGTTWCRFGIGDSVGMAVRLEERYKSIRGPHKIKGGVSGCVRECAEAQNKDFGLIATEKGFNIFVGGNGGAKPRHSELLAKDVPPDDVVPILDRYLSFYIRTADKLQRTARWMENLPGGIKYLQEVILEDKLGICADLEKQMEDLVGTFFCEWTEVLKDPKKRSWFSQFANTSETISDTIEPTQERGQERPSYWPKDSITEDFRGHKWTELSWQPLVKAEEFKDTDTGDSKAIKRGDTQLAVFKVRGKYYCTQQMCPHKRAFVLSDGLLGEDLASNKLWVSCPYHKRNYELSGDNAGKCANDESVNIAVFPIEERGDGYLYVKLPSVEELDSVLGTSKFVIKKSETEDPFVALDKKLERLALKGRKGTQVSHLENGLGEKGKAAMILAGGERGAGGLDW

SEQ ID NO: 29197 - protein, 564 aa, Yarrowia lipolytica
MCGIFAAYKLPDVAEYKTHALQLSKRIRHRGPDWSGNCSKNNTIICHERLAIVGLDTGAQPITSPDESIVLGVNGEIYNHRILRKEFPDYKFKTHSDCEPIIPLYEKYGIDAPKKLDGMFAFVLYDSNKDRIIAARDPIGITTLYMGRSYKNPQTVWFASELKCLVDDCDEIKAFPPGHVYDSDTDKITRYFEPSWWDGSKIPTKRVDYKELREALEAAVRKRLMSEVPYGVLLSGGLDSSLIASIAARETRRAAPEKTVNQDLAGVDEQGHLTNSSGSRLHSFSVGLPGAPDLLAAQKCAEFIGTIHHEYTFTVQEGLDALRDVIYHLETFDVTTIRASTPMYLLSRKIKAGGVKMVLSGEGSDEVFGGYLYFGAAPSPEAFHTECVQRVKNLHYADCLRANKSTMAWGLEARVPFLDKQFLEVAMNIDPKDKIIDKDHIEKYSIRKAFDTSDEPGAEPYLPDEILWRQKEQFSDGVGYSWIDGLKDAAENTITDEQLKNPKPHWGADVPKTKEAYWYRCMFDELFPQPAAATTVMRWIPKADWGCAEDPSGRYVKSHSAHKQ

SEQ ID NO: 29198 - protein, 314 aa, Zea mays
  misc_feature (80)..(80): Xaa can be any naturally occurring amino acid
MACYNTASLAATLLAFALTFQACLAGRRLTALVQEPAITMRYHKGALLSGPIAVNFIWYGDFSAPQRAAITDFVSSLTAXAPAAAQPEPSVATWFKTARKYYASSKVPFPALRLGSHAVDRNCSLGRRLTERDLLRLAARGAPSRAINLVLTAADVAVDGFCESRCGTHGASPRSRSGRFAYAWVGNPASQCPGQCAWPFHQPVYGPQAAPLTPPNGDVGVDGMVISLASMLVGTVTNPFGNGFYYQEGSADAPLEAATACAGVYGKGAYPGYAGSLLVDQASGASFNANGAHGRKYLVPALVDLDTSSCATLV

SEQ ID NO: 29199 - protein, 156 aa, Zea mays
  misc_feature (65)..(65): Xaa can be any naturally occurring amino acid
  misc_feature (101)..(101): Xaa can be any naturally occurring amino acid
MAASSQAFLLLTLSMALVHFSLAQSPMMAPSGSMSMPPMPSGGSPMPMMTPPPMPMMTPPPMAMXPPPMPMTPPPMPMAPMPMTPSSSPMSPPTTMAPSPXPVPDMASPPMMPGMDSSPSPGPMPPAMASPDSGAFNVRNDVVAISFLVAAHLLLV

SEQ ID NO: 29200 - protein, 187 aa, Ostreococcus tauri
MRSLAPGRALTHQRARVHTRARRMDAVVRAFFGGGAPKNTKSAHGFTVKTIDGESVELSKYAGKVCLVVNELVQLDKKYDDLEVLAFPSNEFGGQEPGSAAQIKEFAKKYGATFPMFEKTMVNGPSANPLWKHLKETAPESGLMALAGSEIKWNFAKFLLDKDGKTVGRYAPTSSPLSIESDILKYL

SEQ ID NO: 29201 - protein, 624 aa, Clostridium difficile
MDGNISIYYKGDISKKEDIKFKIKESVNNTRLSSRIEYKDEEKTFDFERFNVIDAIYGNKPFEKDGKVIVFNGNIYNYHEIKEELIKKGHNFTTNDDIEVLLASYIEFGKNCVHKIKGMFNFIIYDRENESIFGARDLFGIKPLYYINKENAIIFSSEYKFLLEYMKNLNINERSLQSYFSFQYVLPEDTMIQGIRLIPAGHYFRVENGILSLKRYNKLEFRSSTKFFYTKNHLGNRDVNEDDIRNIVVDSIVTHMEEEKEIGTFLSGGIDSSIITTVASQINPNIKSFSAGFSVKGYSELEVAKKTADKLGIENIQINITQDEYIKSLPNVIYSLDDPIADPSEVGLYFLIKEAGKHVKVALSGEGADELFGGYNIYKEYSTMKSVVNSPTYIKSILGRVSELMPNIKGRNYLYRATTPLEKRYIGNAKVFENSEVKRFFFKYKEKNIYEYLLSNLYRDAQKNNYDYISKMQHIDVNTWLQGDILQKISKLSTAEQVELRVPFLYKDVFDVAKNLRMEQKINKNNTKVLLREAFREIVPEHVVQRKKLGFPTPIRVWLKDSLGDIVKETIYNSNVDEFIDKKYAIKLLDTHLKGHRDNSRKIWTIFTFCLWHQLFIEHKNVEY

SEQ ID NO: 29202 - protein, 1100 aa, Oryza sativa
MDTGMRVALHRQVSSGSLKESGELRRQSSLESPRTGRAATRFLFGRQSSMDPNRRRGRSQSPVGLAEDLTVPDNLDATMQLLFLACHGDAAGVEALLRGGVDVNSINLDGRTALHIASCEGHPDVVRVLLTWKANIDARDRWGSTAVADAKCYGHTEVYNLLKARGAKIPRNRRTPMMVSNPGDVPEYELNPSELQFKKGDEVVKGVYQVAKWNGTKVHVKILDRECYCDQEVINSFRHELTVLEKVRHPNVVQFVGAVTQNIPMMIISEYLPNGDLSSCIPRKGKLHGQKVLKYGLEIARGMTYLHQCKPDPIIHCDLKPKNIFLDSGGQLKIAGFGLTRLSKISPGRVKLADHESMVDSFSHYTAPELYRNEIFDASVDAFSFGFILYEMVEGTHTVHGKSSEESGHTIRYDGMRPSLKNKLRGYPPDFKALIEECWDTQGNDTCGLSCMNAFLCTYHCEANASLSVKKKPELALTRLEEDDTTYRQICAGAAAVRAMEEGRGGDPPSSSSSSAAAAGVAIGYPFLEPQQGARLRRRRTISPFKKYFSRGFAIAQIRGDESYDSSVPTARDPLHAQIELYPFRRVVYPSLWPSDSCKESLDASNNFSFGFFDGILSDFSKVFKFKSVHLEGDEVNTSCCTAIPHIKKWEEIFNNFGYKLDHRAVVHNCFPDVWVPLLVGTRVSLTSAWTREEVALYRKALKPWRECPFDIQLECNSLTGSKAVQDHSRYNLPSQCTNAPDPPPLPGTSYGAHRTSRNAKACRCVPEEIQDFWDKMFFEAYQYDLRVLTEDGNEVMSHSCVVQGIKSPVLRAMLEEAKVQGGIRHILIPGVPSEAVHVFIRFLYSSRFEQYQMKRYVLHLLVLSHVFSVPSLKRVCINQLETSLLSPENVVDILQLARLCDAPRLSLICTRMIIQDFKTITQTEGWRVMRQANPSLEQELLESLVEEDTKRQERARKLEENKVYLQLHEAMEAIVHICRDGCRTIGPRDQTLKSGQAVCRFPACKGIELLLRHFSACKMRVPGGCANCKRIWQLLELHSRMCSAPETCHVPLCRHFKEKMQHLSRKEEAKWNLLVSKVLESKATTSSISERRKFPSLKT

SEQ ID NO: 29203 - protein, 485 aa, Bacillus licheniformis
MNNQDQSLIFEVSKEGRVGYSLPELDVPETDVTDVIDEAYIRDEPADLPEVSELDIMRHYTALSRRNHGVDSGFYPLGSCTMKYNPKINEKIARIPGFSAIHPLQDEATVQGALELLYDLSEHLEEITGMDEVTLQPAAGAHGEWTGLMMIRAFHEANGDHKRTKVIVPDSAHGTNPASATVAGFETVTVKSNDDGLVDLEDLKRVVDEETAALMLTNPNTLGLFEENILEMAEIVHSAGGKLYYDGANLNAVLSKARPGDMGFDVVHLNLHKTFTGPHGGGGPGSGPVGVKKELIPYLPKPVLVKKDGRYTFDHDRPHSIGRVKPYYGNFGINVRAYTYIRSMGPDGLKEVTENAVLNANYMMRKLAPYYDLPFDRHSKHEFVLSGRRQKKLGVRTLDIAKRLLDFGFHPPTIYFPLNVEECIMIEPTETESKETLDAFIDTMIQIAKEAEETPEVVQEAPHTTVVKRMDETKAARKPVLRYEK

SEQ ID NO: 29204 - protein, 448 aa, Bacillus licheniformis
MKHRYLPATDQDKKEMLEAIGVERIDELFSDIPESVRFKGEYQIKKAKSETELTKELTKLAAKNKDTVTYASFLGAGVYDHYQPVIVDHVISRSEFYTAYTPYQPEISQGELQAIFEFQTMICELTGMDISNSSMYDGGTALAEAAMLASGHTKKKKIVVSETVHPESREVLKTYAKGQYIDVVEVPSKNGTADLEALDEAVCEDTAAVIVQYPNFFGRIEPLKDIKPIAHKGKSMFIVSANPLALGLLTPPGALGADIVVGDAQPFGIPAAFGGPHCGFFAVTKKLMRKVPGRLVGQTEDENGKRGFVLTLQAREQHIRRDKATSNICSNQALNALAASVAMTALGKKGVKEIAWQNLQKAAYAKEAAKRAGLEVAFEGPMFNEFVIRLNEPVEKANERLLEKNIIGGYDLGASYPDLKRHMLIAVTELRTKEEIDTLMNELGDCHE

SEQ ID NO: 29205 - protein, 775 aa, Methanosarcina barkeri
MEEIQLKVEKAYPIDLGRGIIRLDPTTLLKLQLSPGDIVEIRGKKKTTAKVWRADRQDWDQGLVRIDNFIRQNAGVSIGEKVTIKKVEAPEAKKLVLALPESMMQGGPELQFGEHANEIIKRHILKRPVFRGDIIPIINSMSQPMTESLTTSQVIPLVAVETEPSNTIVLVTEETLIELRKKPVQGYEKATRGVTTYEDIGGLGAEIMRVREMIELPMKHPELFGHLNIEPPKGVILYGPPGTGKTLIAKAVANESGASFHYIAGPEIVGKFYGESEERLRKIFEEATQDAPSVIFIDEIDSIAPKRENVTGEVERRVVAQLLTLLDGMVERGQVVVIGATNRVDAIDPALRRPGRFDREIHIGVPDTKDRYEILQIHTRGMPIERDEETEEIGKVETEADEAALERERKEKADKYLMYLAERTQGFVGADLLALVQEAAMRCLRENLPDLDLEKEAIPPERLEKIVVTKRNFEDALMEAEPSALREIYVEMPTVSWNDVGGLDEAKQSITEAVEWPIKNPEKFSHMGIKAPRGILLYGPPGTGKTLIAKAVAKESNANFISVKGPEIFSKWLGESEKAIRETFRKARQVAPCVIFFDEIDSIASMPGMESTDSHTSERVLNQLLTEMDGLESLRDVVVIAATNRPNLLDPAILRPGRFDRLVYIGSPDRKGRLKIFRIHTKDTPLAENVNLETLADETEGYVGADIESVCREAVMIALRENFDTEYVEMRHFREALKKVKPTITENIAQFYEKIEAQFKGGQRLTETAGYIGYR

SEQ ID NO: 29206 - protein, 414 aa, Arabidopsis thaliana
MEEYRLGELRHLLTTVFLSGFSEFLVKPVMTDVTVAAVCSGLNETCSLAVYLTGVEQVTVGLGTMVMMPVIGNLSDRYGIKTLLTLPMCLSILPPAILAYRRDTNFFYAFYITKILFDMAKNVCGRKRISMFGVLAGVRSISGVCATFSARLLPIASIFQVAAISFFFGLVYMRVFLKERLHDDDEDDCDEDDNTSGRNHHDGGDLTMLAEPILRDAPTKIHIVLNTKYSSLKDMYFLKARFGFNKNDFAELILLVTIIGSISQLFILPKLVSAIGERRVLSTGLLMDSVNAACLSVSWSAWVPYATTVLVPVTMFVMPSVCGIASRQVGPGEQGKVQGCISGVKSFSGVVAPFIYSPLTALFLSEKAPFYFPGFSLLCVTFSLMIGFFLSLLIRDVPSPSMNKAINNISREEA

SEQ ID NO: 29207 - protein, 964 aa, Leptospira interrogans
MNSTLQNQTKTNLEKVGTDPLDTFPRRHIGPNLQQTAEMLKELGLSSVEELIDKAVPVGIRLKKSLDLPKASTEHKILQNLKGIASQNQVFRSYIGAGYHSCIIPGVIQRNILENPGWYTAYTPYQAEISQGRLEALLNFQTMIIDLTGLEISNASLLDEGTAAAEAMFLAYSVRKNETAKKFFVSELCHPQTIDVVVTRANPLGIEVQIGNHESIELNEDFFGVLLQYPATDGKVIDYTSFIQRSHNVGAISTVAADLLALTLLKSPGEMGADIAVGSSQRFGLPLGFGGPHAGYFATKDEFKRSMPGRLIGVSKDSQGNSGLRLSLQTREQHIRRDKATSNICTAQVLLAVISSMYAIYHGPEGLKNIATRIYKFTSIFANVLKNAGFSITNEFFFDTITIQAGAKVQEILNRAYSKKINFREYKDGKIGITLDETVNLEDLKDLLEIFEIKNTDIEKLFVDVSNVPDSFKRKTSYLTHPVFQSHHTETKMLRYIRKLESRDLSLTTSMIPLGSCTMKLNATTEMYPVTWPEFGAIHPFAPADQTKGYKIIFEQLEKWLCEITGFAGVSLQPNAGSQGEYAGLLAIRRYHESRNESYRNVCLIPISAHGTNPASAAMAGFQVVVVSCDPNGNVDLEDLKAKAEEHKKDLAALMITYPSTHGVFEESVKEICQIVHSCGGQVYMDGANMNAQVGLTSPGEIGADVCHLNLHKTFCIPHGGGGPGVGPIGVAKHLVPFLPGHVLVNNATGNEHGAVSAAPWGSASIVLISWVYIALMGSEGLTNATRNSILNANYIAKRLEKVYPVLYKGKNGFVAHECILDLRPFKKSAGIEVEDVAKRLIDYGFHAPTMSFPVPGTLMIEPTESESLEELDRFCEAMLLIYQEILDVQNGTLDKTDNPLKNSPHTAAMVTSDRWDHLYPRERAAYPASWLKDHKFWPYVGRVDNVYGDRNLVCSCLPIESYQ

SEQ ID NO: 29208 - protein, 206 aa, Saccharophagus degradans
MSRSKSSGRWLQEHFNDQYVKDSQKDGYRSRASYKLIELNDKDKLIKSGQTVVDLGAAPGGWSQVAAQIVGDGGRVVASDILPMDSLAGVDFVQGDFTEEAVLEQLLELLGEAKADLVISDMAPNMSGIADVDQPKSMYLVELALDMAKTTLKIGGSFACKVFQGEGFDELVLACRECFQKVLVRKPSASRPRSREVYIVAKGYKG

SEQ ID NO: 29209 - protein, 308 aa, Methanosarcina thermophila
MGRIFSDITWTIGNTPLVRLNRITKGLHADVLAKVESFNPMGSVKDRIGLAMIEEAEREGRIKEGTTIIEATSGNTGIALACVCAARGYNLILVMPETMTVERRKLLKALGAELVLTSGAEGMRGAVNKAEQMAADDSALYFIPQQFQNPANPEIHRRTTAEEIWRDTDGKADVIVAGVGTGGTITGIASAIKKRRPSFKAIAVEPAESPVLSGGSPGPHRIQGIGAGFVPDVLQLELIDEIIKVTGDEAAATARRLAKEEGILAGISSGAATWAALQVASREEMRGKTIVVILPDTGERYLSTDLFD

SEQ ID NO: 29210 - protein, 116 aa, Rhizobium etli
MGNQMKIVMAIIKPFKLDEVREALTAIGIQGLTVTEVKGYGRQKGHTEIYRGTVYAVSFLPKLKIEIAVASELVDRAVEAIGASAKTGQIGDGKIFVYSIDHAVRIRTGETDSEAL

SEQ ID NO: 29211 - protein, 257 aa, Oceanobacillus iheyensis
MGKVYLVGAGPGDPELITLKGLKAIQQSDIILYDRLVNEELLGYASKNAELIYCGKSPEHHSLTQDNINKLLCAYAKEDKIVTRLKGGDPFIFGRGGEEAMVLRENGLIFEIIPGITSGSAAPTYAGIPLTHRDYSSSVSFVSGVSKTGEEHERYWEHLAKSSDTLCIYMGVKSLPEICERLIRYGRHSTTPIAVIHWGTTEMQQTVTGTLEDITHVTEKLKNPSMIIIGEVVRLRDEIQWFNEETIEHFNPEVVIG

SEQ ID NO: 29212 - protein, 156 aa, Gossypium barbadense
LKAEMMKNTIKECEQPAIEGEEKYCATSLESMIDYSISKLGKVDQAVSTEVEKQTPMQKYTIAAGVQKMTDDKAVVCHKQNYAYAVFYCHKSETTRAYMVPLEGADGTKAKAVAVCHTDTSAWNPKHLAFQVLKAEPGTVPVCHFLPRDHIVWVPK

SEQ ID NO: 29213 - protein, 868 aa, Aspergillus oryzae
MATITEVRTDALVPTDLVLKTGQIKIESEEISTRDLSDIPLPPPSKRPTEVLSVDKGTPDSHVPRDPRLIRLTGVHPFNVEPPLTDLYKEGFLTSPELFYVRNHGPVPHIKDEDIPHWEISIEGLVEKPLVLNFRQVLQQYDQITAPITLVCAGNRRKEQNNVRKTKGFSWGSAGLSTALFTGPLLADILRSAKPLRKAKYVCMEGADKLPNGHYGTSIKLNWALDPNRGIMLAHKMNGESLRPDHGRPLRAVVPGQIGGRSVKWLKRLILTDAPSDNWYHINDNRVLPTMVSPEMASNNRNWWHDERYAIYDLNTNSAVAYPQNNEVLNLLVAGPSYTVRGYAYAGGGRRVTRVEISLDKGKSWRLAEIEYAEDKYRDFEGELFGGKVDMYWRETCFCWCFWSLSITIPELENSDAILVRAMDEALGVQPRDMYWSVLGMMNNPWFRVTITKENGNLRFEHPTHPSMPTGWMERVKKAGGDLTNGNWGERHEGEEPTEPEPVQDINMKKDGLSRVIGFEEFKENSCDEKPWFIVNGEVYDGQAFLEGHPGGAQSIISSAGLDVSEEFLAIHSETAKAMMPEYHIGTMDPEGLKALKDDASSSTDEIRPVFLQSRSWTKATLKERKDISWDTRIFSFKLEHEDQTLGLPVGQHLMIKVLDTSSNNEAIIRSYTPISETSQKGTVDLLVKVYFATATSAGGKMTMALDRLPLGSVVECKGPTGRFEYLGNGRVVISGKERHVRSFKMICGGTGITPIFQVLRAVVQDRQDPTSCTVLNGNRQEEDILCRAELDGFMATDSRRCNIIHTLSKAPDSWTGRRGRISEELLKEYAAPEDESMVLICGPPAMEESARRILLAEGWKESDLHFF

SEQ ID NO: 29214 - protein, 161 aa, Lotus japonicus
MSTLGSTCFTEEQEALVVKSWSVMKKNSAELGLKLFLKIFEIAPSAQKLFSFLRDSKVPLEENPKLKPHAMSVFVMTCESAAQLRKAGKVTVRESTLKKLGATHYKYGVVNEHFEVTKFALLDTIKEAVPEMWSPEMKNAWTQAYDQLVGAIKSEMKPSSS

SEQ ID NO: 29215 - protein, 466 aa, Salmonella enterica
MSVVPVADVLQGRVAVDQEVTVRGWVRTRRDSKAGISFLAVYDGSCFDPVQAVINNSLPNYNEEVLHLTTGCSVVVTGKVVASPGQGQSFEIQATKVEVAGWVEDPDTYPMAAKRHSIEYLREVAHLRPRTNLIGAVARVRHTLAQALHRFFDEQGFFWVSTPLITASDTEGAGEMFRVSTLDLENLPRNDQGRVDFDKDFFGKESFLTVSGQLNGETYACALSKIYTFGPTFRAENSNTSRHLAEFWMLEPEVAFADLEDNARLAEAMLKYVFKAVLEERADDMKFFAERVDKDAIARLERFVSTDFAQVDYTDAVAILERCGKTFENPVFWGVDLSSEHERYLAEEHFKAPVVVKNYPKEIKAFYMRLNEDGKTVAAMDVLAPGIGEIIGGSQREERLDVLDARMAEMGLNKEDYWWYRDLRRYGTVPHSGFGLGFERLIAYVTGVQNVRDVIPFPRTPRNASF

SEQ ID NO: 29216 - protein, 161 aa, Lotus japonicus
MAENTTTIAFTEEQEALVVKSWNAMKKDSAELSFKFFSKILEIAPPAKQLFSFLRDSEVPLDQNPKLKPHAMSVFLMTCESAAQLRKEGKVTVRESNLKKLGATHFKKGVIPEHFEVTKQALLDTIKEAVPELWSLELKDAWAIAHDQLASAIIAEMKPES

SEQ ID NO: 29217 - protein, 382 aa, Bacillus cereus
MVEKMNEEVMDSKELQVGDVVTGSVTKVEEKQVLVNVGYKTDGVIPISELANVHIEKASDVVELDQILELKVIKLEEDDLVLSKRAVDAEKAWVELQEKFTSGHVFDVTVKDIVNGGLVVDLGVRGFIPASLVEVHYVEDFTDYKGKTLAVKIVELDREKNRVILSHKAVVELELDSKKKEAISSLKEGDVVEGTVQRLTDFGAFVNVGGVDGLVHISQISHERVEQPSEVLEQGQKVKVKVLSVDADTQRISLSIKAAQPGPWENVAGEIKAGDIREGVVKRLVTFGAFVEILPGVEGLVHVSQIANRHVKNPNEVLEMGQEVKVKVLEVHVAEKRISLSIKEALEENNVIEDYSQYEPNADSATFQLSDIIGEQLKKLKK

SEQ ID NO: 29218 - protein, 153 aa, Bacillus cereus
MANYIKELREKVGHDYVFLNFAGGCVFNKEGEVLLQKRGDFNAWGFPGGAMEIGESAAETAIREIKEETGYDVEINELIGVYTKYFQSYPNGDKAQSIVMFFSFSIVGGDKKVDGDETLDLKFFPLDDMPPLFCKQHEDCLQDLLEKRVGVYR

SEQ ID NO: 29219 - protein, 597 aa, Raphanus sativus
MASFTATAAVSRRWAGGNHTQPPLSSPQTSYSSSLHMTSRVQRELNVSSALHTHPALHFPKQPSTSPAIVVNPKTKESDTKQMNSFQRAAAAALDAAEGFLVSHEKQHPLPKTADPSVQIAGNFAPVNEQPVRRNLPVVGKIPDSINGVYVRNGANPLHEPVTGHHFFDGDGMVHAVKFEDGSASYSCRFTQTNRFVQERQLGRPVFPKAIGELHGHTGIARLMLFYARAAAGLVDPAHGTGVANAGLVYFNNRLLAMSEDDLPYQVRITPGGDLKTVGRYDFNGQLGSTMIAHPKVDPESGELFALSYDVVSKPYLKYFRFSPDGTKSPDVEIPLDQPTMMHDFVITENLVVIPDQQVVFKLQEMIRGGSPVIYDEEKVARFGILDKYAADSSEIRWIEAPGCFCFHLWNAWEEAETDEVVVIGSCMTPPDSIFNESDESLKSVLSEIRLNLRTGESTRRPIISDGEEQVNLEAGMVNRNMLGRKTEFAYLALAEPWPKVSGFAKVDLSTGEVKKHLYGDGRYGGEPLFLPGEEGEGAEDDGHILCFVHDEKTWKSELQIVNAVSLEVEATVKLPSRVPYGFHGTFIGANDLAKQV

SEQ ID NO: 29220 - protein, 342 aa, Cyanidium caldarium
MFAFLPSVASYRLQGVHAHGTCSVLGGKELRLLPSRVGCRRGSATLHMVAAEKKVPVNLFKPSSPLVGTCIYNKKIVGDDAPGDTCHVIIHHDGKLPYLEGQSVGIIPEGTDDKGRPHKLRLYSIASTAAGDFGDYKTLSLVVKRLVYTNEKGEEVRGVCSNFLNDIKPGEPIKMTGPVGKEMLMPDDPNATIIMLATGTGIAPFRAFMRKAFVEKHADYQFKGKMILYLGVPTSSSLLYRDELEEMKANFPDQVELHYAISREMKNKQGGRYYLQDSMAERGEEIWQLLRKDNTYVYMCGLKGMDSGIDSFMTDLAAKDGVNWADFKKQLKQQHRYNVEVY

SEQ ID NO: 29221 - protein, 281 aa, Geobacter metallireducens
MCDHSKNIYLPQLATIKEIVDETADIRTFRLEFQDETVRENFTFRAGQFAEYSAFGAGEATFCIASAPTRKGYIECCFRAVGRVTEALRQLEVGDAIGVRGPYGNSFPIEEFFGRNLVFVAGGIALPPLRTLIGQCLDWREKFGDITIVYGARTEGDLVYKRELTEWEERSDVRLVKTVDPGGNSPDWDGKVGFVPTILEEAAPAADNTIALVCGPPIMIKFTLPVLEKLGFSDNAIYTTLENRMKCGLGKCGRCNVGNVYVCKDGPVFTAAQVKAMPQEF

SEQ ID NO: 29222 - protein, 340 aa, Bacillus cereus
MTKITVVGAGSWGTALAMVLADNGHDVRIWGNRSELMDEINTKHENSRYLPGITLPSTIVAYSSLEEALVDVNVVLLVVPTKAYREVLQDMKKYVPGPTTWIHASKGIEPGTSKRISEVIEEEIPENLIKDVVVLSGPSHAEEVGLRQATTVTSAAKRMEAAEEVQDLFMNSYFRVYTNPDIVGVELGGALKNIIALAAGITDGLGLGDNAKAALMTRGLTEIARLGRKMGGNPLTFAGLTGMGDLIVTCTSVHSRNWRAGNLLGKGHSLEEVLESMGMVVEGVRTTKAAHELAEKMEVEMPITAALYDVLFNGNNVKDAVGSLMGRVRKHEVEAIPDLL

SEQ ID NO: 29223 - protein, 152 aa, Escherichia coli
MELTTRTLPSRKHIALVAHDHCKQMLMSWVERHQPLLEQHVLYATGTTGNLISRATGMNVNAMLSGPMGGDQQVGALISEGKIDVLIFFWDPLNAVPHDPDVKALLRLATVWNIPVATNVATADFIIQSPHFNDAVDILIPDYQRYLADRLK

SEQ ID NO: 29224 - protein, 333 aa, Desulfovibrio desulfuricans
MNLAKFPRRGYVQQATPIEKLDNFSAALGGKVQIYIKRDDLLPGCAGGNKTRKLDFCIADALEQGADTIITCGAVQSNHCRLTLAWAVKEGMDCHLVLEERVKGSYKPQGSGNNLLFHLMGVKSITVVPGGSDMMEAMTKVAGTLKEQGRNPYIIPGGASNTIGATGYVACAQEMMQQLFEQGINIDHMVVPSGSAGTHAGIVVGMAATNSGIPVSGVNVSRTKPVQEELVHKLACATAERVGVSGGIAREEVVCFDGYVGAGYSLPTDSMVEAVKLLASTEGILLDPVYSGKAMAGLIDLVRKGHFPEGSNVLFLHTGGSPALYAYTDTFME

SEQ ID NO: 29225 - protein, 257 aa, Robiginitalea biformata
MAKNILELFSLEGKKALVVGGAGDLGKAMVEALAQAGAQTVIIDFDERVFELCDKFRADGLQVDPIRADVSEISQVRESYKEALEKLGGTIDILVNSAGIQRRYPSEEFPEEEWSKVIAINLDATFYYCKYAANDMIKNGGGKIINIASLMSFLGGITIPAYAASKGGVAQLTKALSNDWAAKGICVNAIAPGYMDTQLNTALIADKKRTDEVMLRVPMKRWGDGEDLKGLTVFLSSAASDYITGCVIPVDGGYLAR

SEQ ID NO: 29226 - protein, 434 aa, Kineococcus radiotolerans
MPSAPQRPLFSRGSWPEARRLADVLRQETTGGLLLLVFTVIALVWANVAGNSYEEVRQFHLGPAALHLDLSIEHWAADGLLAIFFFVTGLELKKEFVAGDLRSPRAAALPIAAAVGGMAVPALLFVLVNVLHPDSPEGALVGWATPTATDIAFALGILAVVGSHLPSALRTFLLTLAVVDDLLGITVIAIFYTEQVHWTPLLLALLTLAAFTVAVQRRVRSWWLLVPLALATWALVHASGIHATVAGVLLGLVVPVLRSEEHGGPEAGPGLSEHFEHRWRPLSTGFAVPVFALFSAGVAIGGVSGFTAAVQDPVALGVIAGLVLGKPIGIVGTTWLLAKLTRAELDENLRWVDVLGMAMLAGMGFTVSLLIGSLAFGEGTAAGEHVTLGVLVGSLLSAVLAAVVLSRRNRVYRRIEAEERVDADGNGVPDVYER

SEQ ID NO: 29227 - protein, 358 aa, Glycine max
MGEEVDTAFVQAPEHRPKSSVIVAEGIPLIDLSPINYQNEDTLLDSSIENLVKEIGSACKKWGFFQVINHKVPLDKRERIEEAAKKFFALGLEEKLKVRRDAVNVLGYFEAEHTKNVRDWKEIYDFNVQEPTFIPPSDEPDDEENVQFQWDNRWPQNPPEFKEACQEYAQEVEKLAYKLMELVALSLGLVPNRFRGYFTHNTSNIRLNHYPACPYPHLALGLGRHKDTGVLTVLAQDDTGGLEVRRKSDGEWIRVKPIFNSFIINVGDMIQVWSNDAYESVEHRVMVNSEKDRFSIPFFLKPALYTDVKPLEELLDDRNPPIYRPVNWGKFRSARMRSNFAKSKVENLQIYDFKFPSN

SEQ ID NO: 29228 - protein, 421 aa, Magnetospirillum magnetotacticum
MHHLIVGAGPAGVTAAEIIRELEPEATITLVGDEPEPPYSRMAIPYMLVGKVGEDGTYLRKGPNHYDRLGITLMPGRRMTGLDPAAKRIALDGGESLAYDRLLLALGARPMRPPIEGLDLPGVHTCWTLADARKIAEEAIPGSHVVLMGAGFVGTIVLEALALRQVSLTVVEMGDRMVPRMMDEVAGGMLKRWCEAKGVRVLTGTGIRRITQAESAADTRDSLVVELSDGATLPAHLVVVSAGVRSNTEAVAASGIALGNGILVDDHMRTSLPHVFAAGDVAQGRDFMSGEAHVHAIQITAAAHGRIAAYNMTGNDQAYHGSLNMNVLDTLGLITCSFGSWQGNGGHCARLVDEAGFRYLRLEFDGTSDVVIGAQAVGTTDHVGALRGLIQSKRRLGPAVKEQMMADPTRFMNGFVQTLHR

SEQ ID NO: 29229 - protein, 950 aa, Neisseria meningitidis
MKLSELFNPNEFAARHLSFGDEAALLAAVGEKSMDEFVGNTVPQSIRMPSELDLPDALTEADALAKLKGIASKNVINKSYIGLGYYPTRVPNVILRNVLENPGWYTAYTPYQAEIAQGRLEALLNFQQVCIDLTGFPVAGASLLDEATAAAEAMAMAHRVGKVKSERFFVDARVYPQTLDVMKTRAKYFGFELVVSDFAKADDGEYFGALFQYVGKDGDVQDLQDVIGRLKAKGTIVAVAADIMSLVLLKSPAELGADIALGNTQRFGVPMGFGGPHAAYFAFKDAFKRSAPGRIIGVSKDASGKPALRMALSTREQHIRREKATSNICTAQALLANLAGMYAVYHGPEGVKRIANRIHALASAFADALVSDGINVVHKVFFDTVTVDFGNKEKADQVFAAALESGYNLRRVNDTQVAAAFHETSACEDLVDLYRAFTGKDTFAFADDVKGRLNAELLRQDDILQHPVFNRYHTEHEMLRYLKKLEDRDLAMNRSMISLGSCTMKLNATAEMLPITWAEFSDIHPYAPEAQTAGYRELLADMENSLKSITGFDAISFQPNSGAQGEYSGMLAIRRYQEAQGEAQRNICLIPKSAHGTNPATAAMLGLKVVVVDTDEHGNVNIDDLKAKAEQHRDALSAIMITYPSTHGVYEEGIRDICRIVHENGGQVYMDGANLNAQIGIMQPAEVGADVLHMNLHKTFCIPHGGGGPGMGPIGLKAHLAPFAPGHALTDTHSASADQTAVAAAAFGSASILPITWMYLTMMGKQGMEQATRWALLNANYVAKRLSEDYPILYTGKNGRVAHECIVDLRPLKAESGITETDIAKRLMDYGFHAPTVSFPVAGTLMIEPTESESKAELDRFIAALKQIKQEVLKVGRGEWPKEDNPLVNAPHTASDVTGEWAHPYSREEAVFPLPFVREHKFWPSVNRVDDVYGDRNLVCSCPPMENYED

SEQ ID NO: 29230 - protein, 416 aa, Magnetospirillum magnetotacticum
MARRYVVVGGGPAGVVCAETLRRQDAEGSITLVCAEPGPPYSRMAIPYAMSGKIDESGTWLRKDWGHYEALGIALLHDRVTGVDSGARQVRLESGAPLSYDALLIATGSSPARPRVPGLDLPGVHSCWTLEDLRRIDPLLKPGRRVLLLGAGFVSCIILQSLVQRGAKVTVSCGSSGRMVRSMMDETAGGMIMRWCRAKGVEVLTAGRPTAIEQRDSGLLVTLDSGKSAEADLVIVGTGVKTNTAFLEGSGIAIEDGIIVDQYLGTNVPGIWAAGDVAQGFNCCTGLTEVHAIQPTAVEHGRVAAMNMSGHPTPFGGSLSMNTLETLGLISCSFGQWMGAEGGKQVRMVDEEHFRYLRLEFQGDRLVGANTVGMTNEIGIIRGLIQTKLRLGEWLERLTQDPSRLAEAYVACAQGV

SEQ ID NO: 29231 - protein, 601 aa, Caulobacter vibrioides
MTAHQTIESQAPADTADRAMTGAEIVVRGLVDQGVEVLFGYPGGAVLPIYDALFHEPRLQHILVRHEQGAAHAAEGYARSSGKPGVVLVTSGPGATNAITGIMDALMDSIPMVVITGQVPTHLIGTDAFQEADTVGMTRSCTKHNYLVKDVRDLPQIIHEAFKIATTGRPGPVLIDIPKDVQFAKGEYFGPGEVASTHAYAPRTKGDAGRIAEAARMIAQARRPIFYTGGGVINAGPKASAALREFAALTGAPVTSTLMGLGAFPAADPAWLGMLGMHGTFEANNAMHDCDVMICVGARFDDRVTGRLDAFSPGSKKIHIDIDPSSINKNVRVDLPIVGDAGSVLEDLIAAWKAANLQPNKAALTDWWAQIDQWRARQCLSYRRSDSVIKPQYAIERLYELTKDKDVYITTEVGQHQMWAAQFFRFEEPNRWMTSGGLGTMGYGLPAALGVQLAHPNSLVVDIAGEASIQMCIQELSTAIQFDLPVKIFILNNEWMGMVRQWQQLLHGERYSHSYSDSLPDFVKLAEAYGAVGIRCDNPAELDAKILEMVNSDKPVIFDCRVEKHENCLPMIPSGKAHNEMIMGEVEDIGNVIGEDGAGLV

SEQ ID NO: 29232 - protein, 72 aa, Bacillus halodurans
MAKEDVIEVEGTVIEPLPNAMFRVELENGHKILAHVSGKIRMHFIRILPGDKVTVELSPYDLTRGRITYRYK

SEQ ID NO: 29233 - protein, 230 aa, Oryza sativa
QCTERDEFSYQEMITHLALNSHPNPKKVLVIGGGDGGVLREVVKHASVEEAILCDIDEAVIRLSKKYLPGMSVGFQHPNATTHVGDGFEFLKTHKNEFDVIITDSSDPEGPAETLFQKPYFELLNDALREGGVITTQAENQWLHLSLIADLKKSCKEVFPVAEYAYTTIPTYPSGQIGFMVCCKDANRNVKEPVRSWTREEEEKLCRYYNQDIHRASFVLPNFARKALGN

SEQ ID NO: 29234 - protein, 360 aa, Gloeobacter violaceus
MRGALCCERCGFCLTVKGSCAVLNNFWYGLAHSPAITSIPRQVVVMGRPLVLYRTVGGRVVALEDRCAHRDTALSGGWVEGNCLRCPYHGWRYAPDGGCTEIPANQPGVAISRLAKVETFPVQERHGLVWVFLGELPEAQRPELPSLPEYAAPGWRAVRGEFTWSGHYTRVIANTVDMSHAPFVHAAAFGRKEAPRIQTYHIESERWRGSASIQFKTKPAYFLKLVLGKTPPDGSITSTFHLPNVTQVHHRFGRIQFILFLVHVPVDERTTHTCWLHLRNFVTHAWADPFMHRDVVRTFRQDDSVVRLQPPGPVPEQLNAEVHAPSDGLEVAYRRLRRLCGRLEWASPTQNPRITEGASP

SEQ ID NO: 29235 - protein, 374 aa, Saccharophagus degradans
MSKRDYYEVLGVSKDVSPQELKKAYRKVAMKYHPDRNSDDPNSEDKFKEASEAYEVLSDAQKRAAYDQYGHAGVDGNAGMGGGAGAGNFSDIFGDVFGDIFGGGGGRRRGGPSRGSDLRYTLDLSLEDAVKGTTVKIRVPTLVSCKPCGGSGAKPGTSPQTCTTCGGHGQVRMQQGFFSVQQTCPNCRGQGKMITDPCKECHGHGRVEETKTLSVKVPPGVDTGDRIRLAGEGEAGADGGPAGDLYVQVDVQDHAFFQREGRNLYCEVPISLFDACLGGELEVPTLDGRVKLKIPAETQTGKLFRLRGKGVTPVRGGAAGDLMCRVIIETPVNLTKKQKELLEELKASMKGEKNSPKQESWFEGMKNFFGDLKM

SEQ ID NO: 29236 - protein, 356 aa, Lotus japonicus
MSLLSDLINLNLSETTDKIIAEYIWIGGSGLDMRSKARTLPGPVSDPSQLPKWNYDGSSTGQAPGEDSEVILYPQAIFRDPFRRGSNILVICDAYTPAGEPIPTNKRHAAAKVFSHPDVVAEVPWYGIEQEYTLLQKEVNWPVGWPIGGFPGPQGPYYCGIGADKAFGRDIVDAHYKACLYAGVNISGINGEVMPGQWEFQVGPSVGISAGDEVWVARYILERITEIAGVVLSFDPKPIKGDWNGAGAHTNYSTKTMREDGGYEVIKKAIDKLGLRHKEHIAAYGEGNERRLTGRHETADINTFLWGVANRGASIRVGRDTEKEGKGYFEDRRPASYMDPYVVTSMIADTTILWKP

SEQ ID NO: 29237 - protein, 374 aa, Pseudomonas putida
MSKRDYYEVLGVERGASEADLKKAYRRLAMKYHPDRNPGDKESEDKFKEANEAYEVLSDASKRAAFDQYGHAGVDPSMGGGGAGFGGANFSDIFGDVFSDFFGGGRGGGRGGAQRGSDLRYTLELNLEEAVRGTTVSIRVPTLVNCQPCDGSGAKKGSTPSTCPTCGGIGQVRMQQGFFSVQQTCPRCHGQGKIITDPCTSCHGEGRVEEYKTLSVKVPAGVDTGDRIRLSGEGEAGTHGGPTGDLYVVISVREHEIFQRDGKHLYCEVPISYTDAALGGELEVPTLDGRVKLKIPEGTQTGKQFRLRGKGVAPVRGGGAGDLLCRVAVETPVNLSRRQRELLEELRDSLEGDSSHSPKASGWFDGVKRFFGDL

SEQ ID NO: 29238 - protein, 289 aa, Unknown
  Mycobacterium sp. MCS
MSDWTAADLPSFAGRSVIVTGANSGLGLVTARELARVGADVVLAVRNTAKGDEAAATMTGNVTVRKLDLQDLASVREFAAGTDRVDVLVNNAGIMAVPYARTVDGFESQIGTNHLGHFALTNLLLPKITDRVVTVSSFMHVLGRINLDDLNWKARPYSAWLAYGQSKLANLLFTSELQNRLRRAGSPVRALAAHPGYSHTNLQGQSGRKLGDALMAFGGEYFATDADFGARQTLYAVAQDLPGDTFVGPKFAMRGPTGPVWRTPLARDMKTAAALWELSEQLTGTRFPL

SEQ ID NO: 29239 - protein, 464 aa, Bacillus halodurans
MDRKETAKLMENVMTELSEKEGFLGIEDDEKRKRIVLSAQEILTTTDKIIKSYIRVSTEHGIMRIPAYRVQHNNISGFYKGGIRFSEFVSEEEVENLAILMTLKNALHRLPFGGAKGGVHVDPRKYSEKELNLISKKYVQRFARDLGPNHDIPAPDLGTNEQVIDWMVGEFKTIHPGQAYLGSFTGKSVENGGARGRREATGKGTFLSYIWLLSQWYDEHVSGNGINRTKQWETISNLKQQADNSDPIRVAVQGFGNVGSVAALEAYQCSEIAHRVVAVSDRYTTLYNEKGLDVRALAAYTIGGKDLPKNSEELAAAGVEASVLPVDAVLTCETDVLILAAIENQIHERNMKQVNARVLVEGANAPISTEADDYFEAAGTVVIPDILANAGGVIVSYLEWKQSRITELYSEDDILDEMGTQMKETLKSVYERYFSSVGHTLRFTCFTLALERLTSLLYKHGKLY

SEQ ID NO: 29240 - protein, 1108 aa, Pseudomonas syringae
MAKKPDAATFIKDPLWYKDAVIYQVHVKSFFDANNDGIGDFAGLIEKLDYIAALGVNTIWLLPFYPSPRRDDGYDISEYRDVHSDYGTMADAKRFIAQAHKRGLRVISELVINHTSDQHPWFQKARNAKPGSKARDFYVWSDTDQKYDGTRIIFLDTETSNWTWDPVAGQYFWHRFYSHQPDLNFDNPHVLDAVLEVMRFWLDLGIDGLRLDAIPYLIERDGTNNENLPETHQVLKRIRAEIDANYPDRMLLAEANQWPEDTQLYFGDSKGPDGDECHMAFHFPLMPRMYMALAQEDRFPITDILRQTPEIPENCQWAIFLRNHDELTLEMVTDRERDYLWNYYAADRRARINLGIRRRLAPLVERDRRRVELLNSMLLSMPGTPTLYYGDEIGMGDNIYLGDRDGVRTPMQWSIDRNGGFSRADPASLVLPPIMDPMYGFQSVNVESQERDPHSLLNWNRRMLAVRKQQKAFGRGTLKMLSPSNRRILAYTREYTAPDGHSEVVLCVANVSSAAQAAELDLSGYAGTVPVEMLGGSAFPPIGQLNYLLTLPPYGFYWFLLATENQMPSWHVEPAQSMPDFPTLVLKKRLEELLEEPLRSTMEDTSLTVYLPKRRWFAGKDKAIEKVNIAYAVRFGDEAHPVLLSEIEVTAGGQTDRYQLPFGLLGEDDISSALPQQLALARVRRSRDVGLITDAFTLETFIRAVIQGMQSDTVIPCADGQLRFEQSSQLAPLGLTHESEVRYLSAEQSNSSVVVGSSLVLKLIRKVSAGTHPELEMGAFLTHAGFKNISPLLGSLVRVGNDGQPNLLMIAQGYLSNQGDAWEWTQNNLERAVRDELAHGVSGQEQHYNALLELADFSRSLGQRLGEMHQILASPTDNADFAVEITSAQDSKASATSVNAQLERALQLLEQRKGDLDKDDQQLVSDLLAHRKQIRQRVEGLAKRSAGGLRIRVHGDLHLGQVLVVKGDAYLIDFEGEPARALEERRAKHSPFKDVSGVLRSFDYAAAMAVRSAQSVDTSPQAAAARKQVAETYLAQAREAFIEGYRLATSGIAHAWKDAKGEDSALELFTLEKAAYEVIYEAENRPAWLAVPLQGLRGLLQPSDGEPI

SEQ ID NO: 29241 - protein, 142 aa, Crocosphaera watsonii
MRLLHTMLRVKDLEESLKFYCDILGMKLLRQKDYPGGEFTLAFVGYGDESDNSVIELTYNWGVDSYDLGDAYGHIALGVHDIYGTCEKIREQGGNITREPGPMKHGTTVIAFVEDPNGYKVELIQIGTQGSAKKETETAKAA

SEQ ID NO: 29242 - protein, 595 aa, Burkholderia vietnamiensis
MVSIWLFQPAIPAGVAQRSMHNPIFMSDLQTSTPNTESFAALFEESLTRQDMRAGEVISAEVVRVDHNFVVVNAGLKSEAYIPIEEFLNDQGEVEVQSGDFVSVAIDALENGYGDTILSRDKAKRLASWLSLEKALDNNELVTGTITGKVKGGMTVMVNGIRAFLPGSLVDTRPVKDTTPYEGKTLEFRVIKLDRKRNNVVLSRRAVIEATQGEERAKLLETLKEGAIVNGVVKNITDYGAFVDLGGIDGLLHITDIAWRRVRHPSEVLSVGQEVTAKILKFDQEKNRVSLGIKQLGDDPWEGISRRYPSGTRLFGKVTNITDYGAFVEVESGIEGLVHVSEMDWTNKNVAPSKVVQLGDEVEVMVLEIDEDRRRISLGMKQCKPNPWDDFSRNFKKGDKITGAIKSITDFGVFIGLPGGIDGLVHLSDLSWSEAGEEAVRKYKKGDEVEAIVLGIDVEKERISLGIKQLEGDPFSNYVAMNDKGSIVDGVVKSVDAKGAVITLTGDIEGYLRASEISQDRVEDARNVLKEGDKVNAMVINIDRKSRGINLSIKAKDSAEQQEAIRGLQSDSSAAATGTTNLGALLKAKLDGQNQ

SEQ ID NO: 29243 - protein, 374 aa, Bromheadia finlaysoniana
MAPVPFLPTAVTENTLRESFVRDEDERPKVAYNVFSHEIPVISLRGSTMREMEVEIEICWKIVAACEDWGIFQVVDHGVDAGLIADMTRLAREFFELPPEEKLRFDMSGGKKGGFIVSSHLQGEVVQDWREIVTYFSYPIRTRDYSRWPDKPEGWRAVVEEYSAKLMELACNLLGVLSEAMGLDREALAQACVDMDQKLVVNFYPKCPQPDLTLGLKRHTDPGTITLLLQDQVGGLQATKDGGETWITVQPVQNAFVVNLGDHGHYLSNGRFKNADHQAVVNSNCSRLSIATFQNPAPDGVVYPLAVREGEKPVMEEAITFAEMYRRKMSRDLELARLKKMGKMESKQKGAAGENAEAIGAAATKPKALNEILA

SEQ ID NO: 29244 - protein, 96 aa, Oryza sativa
  misc_feature (34)..(34): Xaa can be any naturally occurring amino acid
  misc_feature (39)..(40): Xaa can be any naturally occurring amino acid
  misc_feature (55)..(55): Xaa can be any naturally occurring amino acid
  misc_feature (64)..(64): Xaa can be any naturally occurring amino acid
  misc_feature (77)..(77): Xaa can be any naturally occurring amino acid
  misc_feature (84)..(84): Xaa can be any naturally occurring amino acid
FRRVAVAVKGALQIQAPRRVALRVRAAAAAVAVXGCQRXXYSSNISVFPMEACDXIGGEACNVXQMYPEAKLSSSAXLFAVSRXAAEEVDRDYLSY

SEQ ID NO: 29245 - protein, 554 aa, Ostreococcus tauri
MFRSQGARGAQMCSVLAMYDPNAALESGREELMRELSARMRTRGPDGSGYFGSKRYGLAHERLAIMDPEGGKQPIVYEDGAKTYAVCANGEIYNFRKLQAKYGLTAAKTGSDSEVLLQLYKHLGCDFVKELNGIFGFVVIGDDGDHMIAARDHAGIKPLYVGYGENGVMWFASELKAICDQKCERIEEFPAGYYWTPKDGFVKWYNPAWDFDDAVGTKDTSHVRAILEEAILDQTMADVPIGLLLSGGLDSAVVSTVLKPFLEKSGQEYLSFTVGQEGSPDVTAARMMSEFLGTKHHEYLFTSEEACANIENVIYHLETYEPELIRSAIPNYFLAKLTSQHVKVVLTGEGSDELFAGYLYFRDAPSSKHVHNELRRIFGHLHNVNCQRADRMTMAHSLEARVPFLDPRVIDAVMEVDPQYKTIEGEEKPEKHALRALFDGEIPDPVLWRTKAMQCEGVGLNWVDDLQTFCNEQVSDEDYAKAEEIYPINPPQSKEEMYYRRIFEKYYHGMDKFVHVWEGGCRAGGAAWENNQYTRAGVKNVKQLAKGLTGVRGA

SEQ ID NO: 29246 - protein, 336 aa, Unknown
  Frankia sp. CcI3
MRRAAVLTAGSWGSVFAKVLADAGARVNLVARDPEIVRAVNTRQVNPRYLPAIQLPDRVRAMSDAGEALAGAEFVVLAVPSQALRSVLAGWAPLIGPDAVYVSLMKGVEVGSQLRMSEVITQVTGVSPDRIAVVSGPNLAPEIAAEQPAATVVASTSTSTAEAVQAACWTPYFRPYTNTDVIGCELGGAIKNVIALAAGMLEGMGFGTNSLASLMTRGLAETLRLGVALGADPMTFAGLAGLGDLVATCGSPLSRNRTFGEKLGRGLTLAQVEAEQQQVAEGVRSCRPLLAMADDLGVAMPITRQVERVLYEGLPPMEAVKDLMSREPGPEYRLRP

SEQ ID NO: 29247 - protein, 473 aa, Ustilago maydis
MPAVPSVSRQQAVEAIRDQFTLDKPLLESLVARFQELYNYGLANHGAEMQMIPSFVTGVPTGSEKGTYLALDLGGTNLRVCEVALDGKGTFAIKQEKYKVSDQLKQGPVRDLFDYMATSVDNFLTDFGTSSTEDVLHLGFTFSFPVEQTAIDSGHLIHWTKGFNCPDAPGKDVVQLLQEALDRKHIKVKCSALVNDTVGALLAHAYASNGALISAIFGTGTNGAYLEHISKIKKLKTAHGSVSHMVINTEWGGFDDDRKALPVTIYDNQVDRESIRPRNHIFEKMISGMYLGEVARCVLLHLVDQLVLFQGFSSKLFNTQYAFDTAYMSAIEADTQDAASPTSATRKVLVQTMQIKDEYVSAEDVETVRTICNIVGTRAARLSAVAIAATMVQTGNVQGTGLNDDGVKVGMDGSVIEYYPYFEERMRGALRELIGEQGEKRVKIGLAKDGSGVGAALGALQAAKQAASGHRVE

SEQ ID NO: 29248 - protein, 145 aa, Bacillus thuringiensis
MSMSLYYKKIREQLGHELIFIPSVAAVIKNEQGEILFQYPGGEYWSLPAGAIEPGETSEEAVVREVWEETGLKVRVKKQKGIFGGKEFRHTYSNGDQVEYIVVVFECEVIGGKLKSIDGESLKLQYFSLSEKPSLALPYPNNIFL

SEQ ID NO: 29249 - protein, 557 aa, Rhodopseudomonas palustris
MTKRRFRAAAVQTLAKLGDFDFNIALATRYVEDAARQGAELIVFPECMDTGYLFDSPEHCRELAETLTDGPFVKALAALSRKHGVYIASGITEWDPAKEKIFNTGIMFDRKGEVACHYHKQFLATHDQNWFAFGERGCPVVETDLGKIGLLICFDGRIPEIFRAMTMQGAEVIVDMANFFAMDQADMWGPARSYENGVWLVAATKAGYERSIYYPGGSMIVDPKGRVLSKVPYETHGLSIATIDLDAAADKSIYTANDKIADRRPETYGIMALPYEKTPVYGVADRPLIPSKSVTKVAAVQIHVTPDCSVAEVLDMVDHTAKLGAKVITLPEYAFSAQYILTPAEATAAADQAAANLASVAKISARYGCLIAAPIVERAAAGLYVTTVLIGSDGKEIGRYRKTHLTAEERKWAVAGFDYPVFDTPFGRIGVMSGYDAVFPETSRCLAIGAADIILWPAALREPFERELLAVPRAEDNRVAVVLANRVDSPYPGGSVVIPPTGFPQWDINIAAPRVMKLGAVMPKHIDLAVCRQKMMIPKVDMFANRLVETYAPIVAA

SEQ ID NO: 29250 - protein, 885 aa, Methylococcus capsulatus
MKRMLINATQPEELRVALVDGQKLYDFDIEIPAREQKKANIYKGLITRVEPSLEAAFVNFGAERHGFLPFKEILPKYLGAGGEESVSRREIKDVLKEGQEVVVQVEKEERGTKGAALTTYISLAGSYLVLMPNNPKAGGISRRIEGDVRSDMKETLSQLHVPEDMGVIIRTAGGGKTVEELQWDLNYLLQLWEAIERSTREKPAPFLIFQESNVIIRALRDHLRGDIDEILVDNPSTFRLVHSFLQQVMPQFINKARLYQDNVPLFSRYQIESQIETAYAREVPLPSGGAIVIDHTEALTTIDINSARATKGGDIEETALNTNLEAADEIARQLRLRDLGGLFVIDFIDMMAARNQRAVENRLREAVRLDRARIQLGRISRFGLMEMSRQRLRPSLTETALLTCPRCKGQGTIRSVESLALSILRVLEEETMKKNTDRIIAQLPVESATYLLNEKRAAIQQIEVRHNVAITIIPNPHLETPNYDIQRIRSGGAGGEEEIRKSSYQLIAEKSPETPKPTRTPSAAAEAPAVREFIPTAPQPGGGDQRAQAQPGQPGGGLIKRFLNILTGQRIEDQPPSQEASQPSAGLPLPVPFVQTGKTAGAQAETGAPPTDDSDHSGSQRRRDHRDGSRRGGNRRKHPAQRDETTDRRHGGPTSDTEAIQASGTEEQPQTSTDQEERPKSEGGRGRRRDGRGQRRRASVQPIVEAPTEGIADETVVSEIPPAGADLSDPVPAADSGETPDQGDAVGHEPAEGDRVDAELRLRTPRSRRGGVRRRGRGRRDRRPAAPGEQGSEALEPVGIDWGDDTARGRGVEAEANPPGPAEIDDHRREPYSSPAERKETAESDEYRAPGLPPRAWQSPAADLAARDEHPDSPPPVERGAGSSD

SEQ ID NO: 29251 - protein, 537 aa, Solanum lycopersicum
MVSSLLLPTPQILSISSSLQSSLPFKPHNFLQITRKKNTLISSPLRVAAPPTTTTATEEEEKLDSKSSDIEDTENDEQDSSSKFSWRDHWYPVSLVEDLDPSLPTPFQLLNRDIVIWFDKSGSQWVALDDKCPHRLAPLSEGRLDENGDLQCSYHGWSFNGCGSCTRIPQAASQGPEAKAFQSPRACATRFPTMVSQGLLFVWPDENGWERAQATKPPMLPEDFDKPEFATVTIQRDLFYGYDTLMENVSDPSHIDFAHHKVTGRRDRAKPLPFKMEASGPWGFAGANNDKPKITAKFVAPCYSMNKIEIDTKLPIVGDQKWVIWICSFNVPMAPGKTRSIVCSARNFSQFTVPGPAWWQVFPRWQEHWTSNKVYDGDMIVLQGQEKVFLSKSKENGTDVNKEYTKLTFTPTQADRFVLAFRNWLRRHGNSQPEWFGSTDNQPLPSTVLSKRQMMDRFEQHTLKCSSCKKAYYTFEKLQKLLIGSVVVCCASAGIPADVNLRIILGSLAIISAGLAYILHELQKNFIFVDYVHAEID

SEQ ID NO: 29252 - protein, 116 aa, Methanosarcina barkeri
MKYIIAMIRPEKLDSVKKEIQKIGAHGLTVSSISGYGAQGGHLNVDRTKTEKYEANLLDKVKIEIAVKDEFLQTTVEAIERGSKDVDGYIGSGKIFVLPLENVMRIRTKETGNDAL

SEQ ID NO: 29253 - protein, 423 aa, Magnetospirillum magnetotacticum
MMSSTDLDAVMTELGERARAASRILALTPSAAKDKALRAAAQAIRIDAKLILAANAQDMEAGTAKGLSASMLDRLMLNSARIEAMAKGLEDIARLPDPVGRSLAEWTRPNGIHISRVAVPLGVIGIIYESRPNVTADAAALCLKSGNATILRGGSESFHSSQAILRALKGGFTACGLPADAVQMVPTTDREAVGVMLRLSDYIDVIVPRGGKSLVERVVAESRIPLFQHLEGICHTYVDGSADLEMAKAVVLNAKMRRTGICGATETLLVDAACAKTHLAPLVAMLIDAGCEVRGDQQAMQADGRVLPAAEADWSTEYLDAIISVKVVDGVKAAVDHINTYGSHHTEAILAEDAGAAEAFLNGCDSAIVLWNASTQFADGGEFGMGAEIGISTGKMHARGPVGVEQLCTFKYVVRGSGQVRPG

SEQ ID NO: 29254 - protein, 731 aa, Magnetospirillum magnetotacticum
MSPRRRILPGSANPLGATWDGNGVNFALFSAHAEKVELCLFDRRGLREVERITLPEYTDEVWHGYLPDCRPGQLYGYRVHGPYDPNEGHRFNAHKLLLDPYAKAHAGSFEWSDTHFGFKPGTPKQDLIADKRDNARFMPKCRVLDTAFTWGDDRRPNVPWPETIVYEAHVRGMSMKHPGVTNGMRGTFLGLTQPGIIDHLRRLGVTTLQLLPIHAMIDEKHLADKGMRNFWGYNSIGFFASDARYYSASPHGDFKTMVARLHDVGIEVILDVVYNHTAEGNHLGPTLSYRGIDNLSYYRLGPDGKRWYENYSGCGNTLNLAHPRVLQMVMDSLRYWAEDMHVDGFRFDLAASLVRGKGGFDHTSGFLDAVRQDPVLSKLKLIAEPWDLGGDGYRVGRFPPGWSEWNGRYRDTVRRFWTGEGGVIGDLASRLTGSSDIFGWGGRRPWASLNFVTCHDGFTLADLVTYERKHNEANLEANKDGSDANYAWNCGHEGPSPYPEITALRARQSRNLLATLLLSQGVPMLLAGDEMGRSQKGNNNAYCQDNELGWVDWSQVDEDLLAFVQMLIGLRKSHPVFRRPRFFEGKRLPNSPLKDIVWITPEGREMGQGDWTTPFARTLGFVLGGESCAVDNLTGREEMDDTFLVLLNAYHEAVPYVLPPPHLGRSWELVLDTNDPAGKQAGTQWMAGITYPLGSRSLAVLRRSGGLRNGPRDASVSPGGVPQDETEGNVE

SEQ ID NO: 29255 - protein, 169 aa, Thermoplasma acidophilum
MYSRITGPAYTRKEFMGGVPYPKITTFVQGNQKKDFPIEMRLVAEEPCQIRHTALEAARVSVNRRMTEAAGLDYFYLKVVPYPHHVLREHKMATGAGADRISSGMRAAFGRPVGTAARVYPDDVIMIARTDEAHAKELKTALRKAAIKLPTPCKVVITKGKEIAGSLGI

SEQ ID NO: 29256 - protein, 404 aa, Nocardia farcinica
MRSQPHVLGIVLAGGEGKRLFPLTADRAKPAVPFGGAYRLIDFVLSNLVNAGYLRLCVLTQYKSHSLDRHISQTWRLSGFAGEYITPVPAQQRLGPRWYTGSADAIMQSLNLIYDEDPDYIVVFGADHVYRMDPEQMVSHHIDSGAGVTVAGIRVPRSEASAFGCIDSDESGRITQFLEKPAHPPGTPDDPNMTFASMGNYVFTTKVLVDSIRADAENSDSDHDMGGDIIPALVEAGEAGVYDFADNQVPGATDRDHGYWRDVGTIDAFYDAHMDLVSVHPVFNLYNKHWPIRGAAENLPPAKFAQGGLAQECIVGSGSILSAATVRNSVLSSNVVVDDGATVEGSVLMPGVRIGRGAVVRRAILDKNVVVGEGEIIGVDLDRDRERFAVSNGGVVTVGKGVWV

SEQ ID NO: 29257 - protein, 424 aa, Methylococcus capsulatus
MPESMHASSRFVSRLTRQTLALILAGGRGSRLQKLTEWRAKPAVPFGGKFRIIDFPLSNCVNSGIRQVGVLTQYKADSLIRHIQQGWGFLRGELGEFIDIMPAQQRLQESWYAGTADAVYQNLDIIRQRDPEFIMILAGDHVYKMDYGLMLAYHVERKADLTIGCMEVPLADAKAFGVMQMDGEQRIRKFVEKPSDPPPMPNRPDHAAASMGIYIFNTAFLFEQLIKDADTPGSNHDFGMDIIPQVIQKYRVFAYRFRNAQSGVQAYWRDVGTVDSYWAANMELIGVDPELNLYDQEWPIWTYQAQTPPAKFVFDDDDRRGMAVDSMVSGGCIISGAEVRHSLLFSNVRVNSFSRVLDSVILPDVNIGRHCRISRAVIDKGCNIPPNTVIGENLEDDRKRFYVSPEGIVLVTPDCLGQRLHFHR

SEQ ID NO: 29258 - protein, 366 aa, Sorghum bicolor
RPLEYAWNKAANILFAESPAGVVFSYSNTSSDLSMGDDKMAQDTYTFLVKWFERFPHYNYREFYIAGESGHFIPQLSQVVYRNRNNSPFINFQGLLVSSGLTNDHEDMIGMFELWWHHGLISDETRDSGLKVCPGTSFMHPTPECTEVWNKALAEQGNINPYTIYTPTCDREPSPYQRRFWAPHGRAAPPPLMLPPYDPCAVFNSINYLNLPEVQTALHANVSGIVEYPWTVCSNTIFDQWGQAADDLLPVYRELIQAGLRVWVYSGDTDSVVPVSSTRRSLAALELPVKTSWYPWYMAPTEREVGGWSVQYEGLTYVSPSGAGHLVPVHRPAQAFLLFKQFLKGEPMPAEEKNDILLPSEKAPFY

SEQ ID NO: 29259 - protein, 208 aa, Pseudomonas putida
MVQRSKSSANWLREHFNDPFVKQAQKDGYRSRASYKLLEIQEKDRLIRPGMSVIDLGAAPGGWSQVTSRLIGGQGRLIASDILEMDSIADVTFIQGDFTHDEVLQRILEAVGDSHVDLVISDMAPNMSGTPAVDIPRAMFLCELALDLATRVLKPGGDFLIKIFQGEGFDVYLKDVRSKFDKVQMRKPSSSRDRSREQYLLGRGFKGA

SEQ ID NO: 29260 - protein, 554 aa, Bacillus cereus
MSRKIVVVGGVAGGASVAARLRRLSEEDEIIMVERGEYISFANCGLPYYIGGVITERQKLLVQTVERMSKRFNLDIRVLSEVVKINKEEKTITIKNVTTDETYNEEYDVLILSPGAKPIVPPIPGIEEAKALFTLRNVPDTDRIKAYIDEKKPRHATVIGGGFIGVEMVENLRERGIEVTLVEMANQVMPPIDYEMAAYVHEHMKVHNVELVFEDGVDALEENGTVVRLKSGSVIKTDMIILAIGVQPESSLAKDAGLALGVRGTIKVNEKFQTSDPYVYAIGDAIEVKDFVTETETMIPLAWPANRQGRMLADIIHGHTDSLYKGTMGTSVAKVFDLTVASTGVNEKILKRLNIPYEVVHVQANSHAGYYPNATPVLIKLIFNKDSGKIYGAQALGRDGVDKRIDVIATAMKANLTVIDLPDLELSYAPPYSSAKDPVNMVGYAASNIVDGFVDTVQWHEIDHIVENGGYLIDVREPNELKQGMIKGSINIPLDELRDRLDEVPMDKEIYITCQLGMRGYVAARMLMEKGYKVKNVDGGFKLYGTVLPERVVY

SEQ ID NO: 29261 - protein, 1009 aa, Xanthomonas oryzae
MGRTRASCQLRCGSTIRLPLPRMPAMSQTPSSLRDLEHHSAFVERHIGPNDAEIAQMLEVVGHASLDALTDAIVPGNIKSPAPLALPEALTEEEALVKIRAIADKNTVYRNFIGQGYYGTHTPKVILRNILENPAWYTAYTPYQAEISQGRMEALINFQTLCADLTGMQIANASLLDEATAAAEAMTLAKRSAKSRSDIFFVHDAVHPQTLELLRTRAEPLDIMLRVGTPEEALQAECFGVLLQYPDSFGHIGDHAALAEAVHAQGGLVAVATDLLALTLIAAPGQWGADIVVGNSQRFGVPFGFGGPHAAFMACRDAYKRSMPGRLIGVSIDAAGNPAYRLTLQTREQHIRREKATSNICTAQVLLAVMASMYAVYHGPDGLTRIARRTHRLAAILAAALRGAGVTVGEHFFDTLHVKAIDADAIHARARAAGINLRAIDSEAVGISLDETTTRADVVALAQLFGAMADVDALDAATADALPQGLLRSSAFLTHPVFNTHHSEHELLRYMRSLADKDLAMDRTMIPLGSCTMKLNATAEMIPVTWPEFGAIHPLAPAEQSAGYAQLIDELEAMLVECTGYDAVSLQPNSGAQGEYAGLLAIRAYHRSRGEAHRDICLIPESAHGTNPASAQMCGMTVVVTKCDANGNVDVDDIRAKAEKYSDRLAALMITYPSTHGVFEEDVVAICEAVHAHGGQVYTDGANMNALVGVAKPGKWGSDVSHLNLHKTFCIPHGGGGPGVGPCAVKSHLAPFLPRAGLHAGEGQTAAIHGGGFNSGSGSGHSSRIGGMVSAAAYGSASILPISWMYVTMMGSAGLRKATQVALLNANYIAKRLAPHYKTLYTGRNGLVAHECILDVRPLEKTSGIGAEDIAKRLIDFGFHAPTLSFPVAGTLMVEPTESESQHELDRFIDAMIQIREEIRAIEDGRLDREDNPLKHAPHTATQVSASEWTHAYPRELAAFPLPSLKQQKYWPPVARVDNVYGDKNVMCACIPVDAYKIPVDAYKEDAEA

SEQ ID NO: 29262 - protein, 160 aa, Oenococcus oeni
MSIYDYKATLENGESYKLDKYKGKIMVIVNTATKCGFAPQFEELEKIYKQFKDSGLVVLGFPSNQFKQELDSSQAAAEACRTTYGVTFLMHEINDVNGKDELPLFSYLKDNAPGAIGKSIKWNFTKFLVKQDGEVAKRYAPKTDPEKMIPDIEELLQLQK

SEQ ID NO: 29263 - protein, 411 aa, Lactobacillus johnsonii
MNYGEKSPALWDAIKSEEKRQEDTIELIASENIVSDAVREAQGSVLTNKYAEGYPGKRYYGGCQYIDKVEQLAIDYAKKLFNAEYANVQPHSGSQANMTVYNALLKPGDTILGMGMDAGGHLTHGSKVNFSGKIFNSISYDLNPETEELDFDRIRQLAIEKKPKLIIAGASAYSRIIDWQKFREIADEVGAYLMVDMAHIAGLVATGAHPSPVPIADVVTTTTHKTLRGPRGGMILSNNKELGKKIDSALFPGTQGGPLEHVIAAKAQAFYEDLQPEFTQYIDQVIKNSKAMAEEFKNSKNIRVVSGGTDNHLMIIDITKTGVTGKDAQNLLDSVNITTNKESIPGDKRSPFITSGLRIGTPAITSRGFKEPDAKEVAKIIIEVLDKPEDAGVLAEAKERVNDLVQKYPIK

SEQ ID NO: 29264 - protein, 1142 aa, Unknown
  Bacillus sp. KSM-1876
MKGKLKKFLVLSMVFILTFSSFGMMGTTQLVEAETKSSIEESEIPENTLRIHYQNSSGDYSNLGVWTWDDVESPTDNWPSGGIPFTEEQVTDYGAYVDVPLESGARNVGFLILDIVTGGKDDAGHNGGDKRLELFSPNINEVWISEGSDEISFIEPVDLPEDTVRVHYKKADGNYENWSLWFWGDVQSPSETQGDFPSGATGFSEEQIGKYGAYIDIPLNEGAEEIGLVVVNKETNEQEADRSFTQLNQFNQIFIVEGDGAVYSNPYGAIATELLSAEQLSDEKIVLYFSRTDELTEEALLEQVGIRDIEEHTVDVNEVEIKTDNRTVEVKGDFNLDQSPYTVSLGEVSVPAKIGWRLIDEMYAYDGELGAQLHQDGTATIKLWSPKAEHVQVILYDKDNPDDIVTEVEMKLGDRGVWEVQLTKENTGLDSLRGYYYHYEIDHDGDKKIALDPYAKSLSAWNSDEQGPYAKAAIVDPSSIGPELEFAHIEGFEKKEDTIIYEVHVRDFTSDPHIADELTAQFGTFASFVDKLDYIEDLGVTHIQLLPVMSYFFANEFKNDERMLDFSSTNTNYNWGYDPQSYFALTGMYSEDPTDPELRIKEFKKLIDEIHSRGMGVVLDVVYNHTARVGIFEDLVPNYYHFMDADGTPRTSFGGGRLGTTHEMSRRILVDSITYWVEEFKIDGFRFDMMGDHDAESIQIAYDKAKEINPNIVMIGEGWITYAGDEDDPNVQAADQHWMQYTESVGVFSDEFRNELKSGFGHEGEPRFLTGGARNIDLIFDNIKAQPHNFIADDPGDVVPYIEAHDNLTLHDVIAMAIQKDPDDHQEEIHQRIRLGNLMTLTSQGIAFLHAGQEYGRTKQFRAETSEPPYKSTYMTDENGEPFRYPYFIHDSYDSTDIINRFDWERATNADAYPIQNLTREYTTGLIELRRSSDAFRLGTKDLVDEKVTQLNIPEIEETDLVVAYRIEATTGEAFYVFVNADDEERTLTLEEDLTVGEFVVDGKTAGVTAIAEPQGVELSAEQIKLDPLTAAIVQVGGIEAPEKPTPPKEEPKEPKEPKEPKEPKEPKDPKDPKDPKDPLDPPGTDDQNGETPKGNEEKKEEQKGDNLPNTATSNYQFIALGIALVLMATAIYWWKRKRQVA

SEQ ID NO: 29265 - protein, 824 aa, Clostridium difficile
MNELKRVSLYNIHKELGAKLVEFAGWEMPLEYEGINKEHEKVRKSAGIFDVSHMGEVQIKGAESEKFIQNLVTNDISTLKINDIIYTPMCYENGGVVDDLLIYKFGEEDYLLVINAGNIDKDVAWIIKQSEGYNVDIKNISSEVSQLAIQGPKAEEILQKITDIDLNSIKFYKSIPSIIVCGCPCLVSRTGYTGEDGFEIYCKNKYVEIIWNEVLKVGGEDICPAGLGCRDTLRFEAALPLYGHEINEHISPIEGGLSIFVKTNKESFIGKSILSKEKESGAKRKLVGFEMQGKGMPRNGYDIRIGDKTVGFVTTGCASPTTGKILGMGIIDSEYAKVGNEIGIAIRKKVVPAVIVKKPFYKKQYKKDNIILNKENKFSYIPATSEDKSKMLKVVGLNSVDELFSDIPEEVKLKRDLNLEIGKSELEVSKIVKRLSEENLSLEDLTCFLGAGAYDHYIPSIIKHITSRSEFYTAYTPYQAEISQGTLQVVFEFQSMIAEITGMEIANASMYDGATAAIEACIMAMNQTRKSKIVVSKTIHPETLSVLRTYLQYKDCEIVEIDFCNEYGTTDIEKLKASVDKDTACVLIQTPNFFGIIEEMEEIEKITHENKAMLIMSVDPISLGVLKTPGEIGADIVVGEAQSLGNPLNFGGPYVGFLASKSKYTRKMPGRIVGQSLDVEGKIAYVLTLQTREQHVRREKATSNICSNQALNALVASIYMATMGKEGFKEVGMQSMKKAHYTYNKLVQTGKYKPIFKGKFFKEFAVQGNLNIETINDKLLEENILGGYNLEYNYPELKNSTLLCVTEKRSKEEIDKLVGIMEGL

SEQ ID NO: 29266 - protein, 599 aa, Streptococcus agalactiae
MLYPLLTKTRNTYDLGGIWNFKLGEHNPNELLPSDEVMVIPTSFNDLMVSKEKRDYIGDFWYEKVIEVPKVSEDEEMVLRFGSVTHQAKIYVDGVLVGEHKGGFTPFEVLVPECKYNNEKIKVSICANNVLDYTTLPVGNYSEIIQEDGSIKKKVRENFDFFNYAGVHRPLKLMIRPKNHIFDITITSRLSDDLQSADLHFLVETNQKVDEVRISVFDEDNKLVGETKDSRLFLSDVHLWEVLNAYLYTARVEIFVDNQLQDVYEENFGLREIEVTNGQFLLNRKPIYFKGFGKHEDTFINGRGLNEAANLMDLNLLKDMGANSFRTSHYPYSEEMMRLADRMGVLVIDEVPAVGLFQNFNASLDLSPKDNGTWNLMQTKAAHEQAIQELVKRDKNHPSVVMWVVANEPASHEAGAHDYFEPLVKLYKDLDPQKRPVTLVNILMATPDRDQVMDLVDVVCLNRYYGWYVDHGDLTNAEVGIRKELLEWQDKFPDKPIIITEYGADTLPGLHSTWNIPYTEEFQCDFYEMSHRVFDGIPNLVGEQVWNFADFETNLMILRVQGNHKGLFSRNRQPKQVVKEFKKRWMTIPHYHNKKNSVK

SEQ ID NO: 29267 - protein, 269 aa, Unknown
  Burkholderia sp. 383
MGRRLDWHEETRMTNALERFRLDGRRALITGSGRGIGLTLARGLAEAGAAIVINDRNEEKAATLVRHLREEGFTADYAVFDVAEHAQVRAAIDDFEARVGAIDILVNNAGIQRRAPLDAFEPDDWHALMRVNLDGVFNVAQAVARHMIARGRGKIINICSVQSELARPTIAPYAATKGAVRMLTKGMCADWARHGIQANGLAPGYFETELNRALVDDAAFSDWLCKRTPAGRWGRVDELCGAAIFLASAASDFVNGQTLFVDGGLTSAV

SEQ ID NO: 29268 - protein, 485 aa, Clostridium difficile
MKEYNSLLIDISKKGRKAYSLPKLDIDDIKIEDMIDQDMARQSELNLPEVGELELVRHYTLLSNKNFGVDTGFYPLGSCTMKYNPKINEDMAALPNFTGMHPYQSSDTAQGSLSLMYDLSRRLAEITGMDEVTLQPSAGSHGEFTGLMIIKAYHENRGDHKRTKVIIPDSAHGTNPASAAMANFDVIQIASDKNGAVDINVLKEVLNDEVAALMLTNPSTLGLFEKNIKEIATLVHEAGGLLYYDGANMNAIMGITRPGDMGFDVVHLNLHKTFSTPHGGGGPGAGPVGVKKELVPFLPIPVIERKEDKYVLNYDREKSIGKIKNFYGNFGVLVRAYTYILTMGRDGLKEASEMAVLNANYIKESIKDDYILPIDTLCKHEFVLGGLPRGEANIKTIDIAKRLLDYGYHPPTMYFPLIINEALMIEPTESESIETLDSFIEAMKSVAKEAKEEPELLKTAPHNTLVKRVDDARAVKKPILTWSQR

SEQ ID NO: 29269 - protein, 484 aa, Lactobacillus johnsonii
MKFSEMNLKPEILKAIKRSGFEEATPIQEKTIPLVLEGKDVIGQAQTGTGKTAAFGLPILQNLDKQHDSIQAIIIEPTRELAIQTQEELFRLGRDEKARVQVVYGGADIRRQIRALKQTPAILVGTPGRLLDHLKRGTIDISKVKTIVLDEADEMLDMGFIQDIESILKYASSKHQTLLFSATMPKPILRIGEKFMNDPEIVKIKGKELTANLIDQYFVRAKENEKFDILCRLIDVQNPDLAVIFGRTKRRVDELTRGLQARGYNAAGIHGDLSQAKRMSVLKRFRKGKLDILVATDVAARGLDISGVSHVYNYDIPQDPNSYVHRIGRTGRAGQNGMSVTFVTPNEIGYMRTIEQLTHKKMMPLKPPTDEEAFKGQLSAANKKVAELLDSDLSKYTEEASQLLDDYSAIDLVAALLKDLSKDADSVKVKITPEKPLPFKSKHGNNRNFKRNFKRGGDRNERYHRKPSARKGGRKHDFVIKKKD

SEQ ID NO: 29270 - protein, 983 aa, Burkholderia vietnamiensis
MSLDTQNVRQGGCGSGQCACKSAAAARARDPFDETDYGTPQRHADTDVTLEIDGQAVTVPAGTSVMRAAIEAGVNVPKLCATDSLEPFGSCRLCLVEIEGRRGYPASCTTPAEAGMKVRTQSDRLQKLRRNVMELYISDHPLDCLTCPANGDCELQDMAGVVGLREVRYGFDGANHLRDRKDESNPYFTYDPSKCIVCNRCVRACEETQGTFALTIAARGFESRVAAGASESFMASECVSCGACVAACPTATLQEKSVVQLGQAEHSVVTTCAYCGVGCSFKAEMKGTQVVRMTPHKNGLANEGHACVKGRFAWGYATHKDRITKPMIREKITDPWREVSWEEALTYAATQFRKLQQKYGRDSIGGITSSRCTNEETYLVQKLVRAAFGNNNVDTCARVCHSPTGYGLKTTLGESAGTQTFASIGQADVIVVMGANPTDGHPVFGSRLKRRVREGAKLIVIDPRRIDVVDGPHVKATHHLQLRPGTNVAMINALAHVIVTEGLVADAFVAERCDTRAFEQWRDFVSRGENSPEATAEVTGVPAEQVREAARLYATGGNAAIYYGLGVTEHAQGSTTVMGIANLAMATGNIGREGVGVNPLRGQNNVQGSCDMGSFPHELPGYRHIGDASVRSQFEHAWSATLQPEPGLRIPNMFDAALDGSFKGLYCQGEDIVQSDPNTQHVAAALSAMECIVVQDIFLNETAKYAHVLLPGSTFLEKDGTFTNAERRISRVRKVMPPLAGYADWEVTLMLSQALGYDMHYTHPSEIMDEIARLTPTFSGVSYEKLDALGSIQWPCNDEAPEGTPTMHIDAFVRGKGRFVITQFIPTPEKVTQRYPLILTTGRILSQYNVGAQTRRTENVQWHEEDRLEIHPHDAEDRGIHSGDWVGIESRAGQTVLRALVSDRMQPGVVYTTFHFPESGANVITTDSSDWATNCPEYKVTAVQVMPVAQPSDWQRSYARFNSEQLELLERRASAPGVATTGK

SEQ ID NO: 29271 - protein, 427 aa, Thermotoga maritima
MWKHVKQVDPEIYEVLVNELKRQEYGLELIASENFASLAVIETMGSMLTNKYAEGYPKKRYYGGCEWVDRAEERAIERAKRLFGAKFANVQPHSGSQANMAVYLALAQPGDTIMGMSLSHGGHLTHGAPVNFSGKIFKVVPYGVNLETETIDYDEVRRLALEHKPKIIVAGGSAYARIIDFKRFREIADEVGAYLMVDMAHFAGLVAAGIHPNPLEYAHVVTSTTHKTLRGPRGGLILTNDPEIAKAVDKTIFPGIQGGPLMHVIAAKAVCFKEAMTEEFKEYQKQVVKNAKKMAEEFQKRGYRIVSGGTDTHLFLVDLTPKDITGKAAEKALESCGITVNKNTIPNEKRSPFVASGIRIGTPAVTTRGMKEEEMEEIAEMIDLVLSNVIDENGTVKPEVREEVSKKVRELCERFPLYRDKIEGVEI

SEQ ID NO: 29272 - protein, 106 aa, Phillyrea latifolia
LNLRPRQVEVWFQNRRARTKLKQTEVDCEYLKRCCETLTEENRRLQKELQELRALKTSQPFYMQLPATTLTMCPSCERVATTPFLFWHHQHHHHNPSTTHHHHHHH

SEQ ID NO: 29273 - protein, 448 aa, Gracilaria gracilis
MGNVTRKAAVQNGKSKAATLVDEAIQTNPVVIFSKTYCPYCQSAKSNIRSALKKIANAPKPEIFELDRMGSLGYQIQNYLAQVTGRHTVPNVFIGGSSVGGGDDIAAYARRGVLVQMLTQAPQRLVHQFPERFEPEKKPDTAAEAVERAIKDNAVMVFSKSYCPFCTSAKDLLQERIAAVEGLNPINVFELDEMGTDGAAMQQYLFQKTGQRTVPNIFIAGKHVGGSDDVHGLDARNELIPMLTSAAASVSSPAATEVLSAEEEQTETDTALPADVVSEEKPKTETKEIVFGAGCFWGVELAFQRVAGVLKTEVGYSNGKMSRVTYDAICTGATGSAEVVRVWYDPSVLFLKQLLEVWESRHDPTSLNKQGNDQGTQYRSAIYYSDEEQAEEVRRWISEASTRHTKEIVTEVAAIKNYCAAEEYHQRYLEKKGQSAEKGSSASIRCYG

SEQ ID NO: 29274 - protein, 77 aa, Leucophyllum frutescens
  misc_feature (28)..(28): Xaa can be any naturally occurring amino acid
MKRQKWIHEGLITESPSNGMFRVRLDNXDLIPSYVSGKIRRSLIRILPGDKVKIEVSRYDSTRGRIIYRLRNKDSKD

SEQ ID NO: 29275 - protein, 77 aa, Borago officinalis
MKEEKWIHEGLITESLPNGMFRVRLDNEDLVLGYVSGKIRRSFIRILPGDRVKIEVSRYDSTRGRIIYRLRNKDSKD

SEQ ID NO: 29276 - protein, 129 aa, Glycine max
MAGSGIVFEGYEKRPQISFFEHGVFADPEGIGLRALSKDQLDEILKPAECSIVASLSNDYVDSYVLSESSLFIYPYKIIIKTCGTTKLLLSIPVILKMADALDIAVKSVRYTRGSFIFPGAQSFSHRNF

SEQ ID NO: 29277 - protein, 77 aa, Garrya elliptica
MKEQKWIHEGLITESLPNGMFRVRLDNEDLILGYVSGKIRRSFMRILPGDRVKVEVSRYDSTRGRIIYRLRNKDSKD

SEQ ID NO: 29278 - protein, 471 aa, Vibrio vulnificus
MAMKLVWLRRDLRCVDNTALNHAIATSQEVVACFVATPLQWRDHHMAPMQADLIARRLAVLAEELNALNIPLLYDEVDDYAQSATRVANWAEQLAVSEVVLNREYEVNERVRDEQLVNRLASSEMGVLDVEDKCVQAPGCVLNKQGDYFKVFTPFKKAWLKSFIPPQIIKTSAAQPVVLPEALQSSLWHEQAPFSYPRQSSEAWSVDSQQIRETLRRFCHEEVDRYHEQRDFPATAGTSVLSPYLAIGAISVRQCIARLYWQQSYLSNGREVWLSELIWREFYHHLIHFEPKLVKGQGFVEWEKHLLWPAKPDWFERWCRGETGYPIVDAAMRQLNQTGWMHNRLRMIVASFLTKDLHVNWRLGEQYFMQKLVDGDFAANNGGWQWCASTGCDGQPYFRIFNPITQGEKFDPNGEFVKHWLPELAEVPSKFVHQPWKWLGHMRLDYPAPMVDHKQEREITLSLYTQAKDCL

SEQ ID NO: 29279 - protein, 605 aa, Methylococcus capsulatus
MCGIAGLVLKGRNVQADRLHPMIERLAHRGPDGQGVFTEGGFGLAHTRLSIIDLSGGRQPILADDGRLAVVANGEIYNHVELREALEREGRRFATHSDSETILHAYALDPEGFAGRLHGMFAFALYDGVRRRLVLGRDRLGIKPLFYAALPDRLVFASEMKAILPLLPNAPTIDAGAFSQFLHTHCSTGEETLFSGIRRLGPGEILEADAELNLRKRRYWTPLGVRSRALDFAEAEAEFEGMFEQVMKEHVRSDVPYGLFLSGGNDSAILLAMLSRLQAQPVRTFSIGYVDAAMKDELGDAERIAQVFGSRHTSIRLRREDLFRRIPHTVWAADDLMRDYASFPTSALSEAAAKELKVVFTGEGGDEVFGGYRRYRQPRLAWLARNLLAPGTGGFRTRSEWWRKRSQRLFGPALAAERKHFRAPYLKAWSEAPAVWSHLQHCQYTDLVTDLPDSLLVKVDRMMMGFGLEGRVPFLDHRVVEFGLGLPDALKTDGKRPKVFLRRWAERHVPKEHLYTKKRGFTVPVREWLGGELLDRLEGKLSGNAAVREWFDTRHFPALFQAQRKKGNASREIFCLMQFAIWHRLFIDQPGLKPSPDEDPLDWIS

SEQ ID NO: 29280 - protein, 265 aa, Capsicum chinense
QRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKTKIQDKEGIPPDQQRLIFAGKQLEDGRTLADYNIQKESTLHLVLRLRGGF

SEQ ID NO: 29281 - protein, 77 aa, Cornus mas
MKEQKWINEGLITESLPNGMFRVRLDNEDLSLGYVSGKIRRSFIRVLPGDRVKIEVSRYDSTRGRIIYRLRNKDSKD

SEQ ID NO: 29282 - protein, 478 aa, Bacillus thuringiensis
MRKTMSQVNNTNNELKRTMKSRHLFMIALGGVIGTGLFNGSGFIISQAGPGGSVLAFMAGGLLMYFVMLCLGELAVAMPVSGSFQEYATKFINPATGFTIGWLYWLSWANTTGLEFTTAGITMQRWFPDIPVWVWCLIFGVTIFTINALSARSYAETEFWFSSIKVSAIIAFIILGGAAMFGLIDLKGDEPAPLLSNFVNHGGLFPNGLAAILLTMVTVNYSFQGTELVGIAAGESEDPAKTLPRSIRNIIWRTMFFFVLAIFVLVALIPWEEAGLTKSPFVAVFDNIGIPYAADIMNFVILTAVLSVANSGLYAATRMLWSLSKNEMAPAFLKKLSSRGIPLNALILTISISAFSLLTSVVAAETVYLWLISISGVITIIVWMSICVSQFFFRKHYVADGGRLEDLKFKTPLYPLVPILGFGLYGIILVSLIFIPDQRLGIYCTVPFIIFCYTYYHFKVKKRISTNTSSENKISETI

SEQ ID NO: 29283 - protein, 77 aa, Brexia madagascariensis
MKEQKWIHEGLITESLPNGMFRVRLDNEDFILGYISGRIRRSFIRILPGDRVKIEISRYDSTRGRIIYRLRNKDSNY

SEQ ID NO: 29284 - protein, 77 aa, Cercidiphyllum japonicum
MKEQKWVHEGLITESLPNGMFRVRLDNEDLILGYISGRIRRSFIRILPGDRVKIEVSRYDSTRGRIIYRLRNKDSND

SEQ ID NO: 29285 - protein, 429 aa, Thermoplasma volcanium
MLSIAEASSEAHVGSEVSVRGWVYRIRSSGGVTFIVIRDSTGIVQCTAKKNELTPEQYDEISSLGIESSLSLIGTMKKEPRSPTGYEISIHKFTVYQKNDVFPITKDQGEEFLLDNRHLWLRSREFTSILKVRSTIFRSFADFFYDQGYYQVHTPFMVSTAVEGGSTLFKVDFFGEPIFLNQSAQFYLETMIYSLEKVFTIAPSFRAEKSRTRRHLTEYWHAEAEVAWIDNREMMDVEENMIYYIIQRVIEENYDDLKLLGRDPEALRAMKPPFPRVKYSDIIKVANEIGMQLKYGDDLGADEERQITMRYCKPVFVTNYPKELKPFYMPQDPDNPSEVLNHDLLAPEGYGEIIGGSQRIWDYKELMQRIREAGLDESAYYWYIDLRKYGSVPHSGFGLGMDRLAMWIMHLDNIREAIPYPRTIRRTKP

SEQ ID NO: 29286 - protein, 486 aa, Leifsonia xyli
MPENDAQANIGVVGLAVMGSNLARNLASREGNTVAVYNRTFARTEDLVGAHPEAGFVASESIDDFVASLATPRTAIIMVQAGKGTDAVIDQLVERFEPGDIIVDGGNANFLDTIEREKRVSATGVHFVGAGISGGEEGALKGPSIMPGGTAESYKTLGPILASIAAIAEGEPCVTHIGTDGAGHFVKMIHNGIEYADMQLIAEAYDLLRMVGGLEPAAIADVFAEWNTGSLESYLIEITAKVLRQVDAETGKPFVDIVLDQAGSKGTGVWTVQNALDLGIPVGGIAEAVFARAVSSKPAQRTAVQRVITSRPEAQRPEDLAAFADDVSKALYASKIVAYAQGFDAIVAGAEKYGWKLDKDKIAKIWRGGCIIRAQFLGRIADAYEENADIATLLEAPYFADALREGEAAWRRIVATAALSGVPVPGFGAALSYYDSLASGRLPAALVQGQRDFFGAHTYKRVDKDGTFHTLWSGDRTEIETEGSSH

SEQ ID NO: 29287 - protein, 430 aa, Methylococcus capsulatus
MTAVSALRPAGPEAVAAYVDGLARRAREVGRILSRAETAAKNRALLAIAAALEESADALIEENRKDLEAGAAKGLDRAQLERLGVDAKRVQTMAVGLREIAALPDPVGEISGLTYRPSGIQVGRMRVPLGVIGIIYESRPNVTADAAGLCLKSGNACILRGGSEAIHSNRAIAACIRRGLEAGGLPADAVQLIETTDRAAVGALLAADEYVDIIVPRGGRSLIERVVAESRIPVIKHLDGICHVYIDDGADLAKARRIAINAKTQRYGVCNAMETLLVAAGIAPAVLPDLAALYRDKGVELRGCPETCRLVPDCVPATEADWDTEYLAPILAVRVVAGLDEAIEHIHRHGSGHTDAIVTEDYGRARRFLREVDSASVMVNASTRFADGFEYGLGAEIGISTDKLHARGPVGLEGLTTQKFIVLGDGHVRI

SEQ ID NO: 29288 - protein, 529 aa, Xanthobacter autotrophicus
MLDTAMKTQLKAYLERLVRPVEITAFVDDGAKSKEMLELLSDITDCSPKVTVAERRDGDAAGARVPSFALSSPGESIALTFAGLPMGHEFTSLVLALLQTGGYPPKLEAEVIEQIKALDGDFVFETYFSQSCQNCPDVVQALNLMAVLNPKIRHVAIDGALFQKEVDARQVMSVPTVYLNGEVFGQGRMGVEEIVAKLDTGAAARDAKRMAEMNRFDVLVVGGGPAGATAAIYAARKGIRTGVAAERFGGQVLDTMAIENFISVPYTEGPKLAAALEQHVREYEVEILNLQKAVKLVPGADIVEVEFANGASLRSKTVILATGARWRQMNVPGEDTYRNKGVAYCPHCDGPLFKGKRVAVIGGGNSGVEAAIDLAGIVAHVTLMEFDSALRADDVLQRKLKSLPNVTILTSAKTTEVLGDGQKVSGLTYENRNTGESVKVELEGIFVQIGLLPNTEWLKGTVELSPRGEIVVDAHGQTSVPGVFAAGDCTTVPYKQIVIALGEGAKASLSAFDHLIRSSAPKEEAVKAA

SEQ ID NO: 29289 - protein, 762 aa, Oryza sativa
MGIIVGYNTKGGLEESKDGDNGMQQDRGRGKEHVRIEVARALGWRCCRSPTDFRRAFRMPCAVFDKLCDHLATVVTKEPSSRRQIEQGSLVEFKAEAKRRGCAEMWRPSESSIARSIGECEHGAASSSWRAALPMPEKEVAQRLVRRAAAGRRRRRHPDVARRPCQGPLSFLLPCLLLCSALGPLKLPMAVPPSRASVCMSKKRREGGGGGNGGCDPPAVTDALSMDGGLREVSLSVVFSVWCLLFLLRSQFLHSQTDPSDFYDDVEDGMRENYCKVMPLEAYIFPTEYNASAAAPTCQPSLHPPDQPQQETDHRSLEPFNNTTGGKSSAEAAALDELDEFRSRILQGKAENGRVPDGATPAAHRLEPSGAEYNYAAASKGAKVLAHNREAKGAANILGGDKDRYLRNPCSADDKFVDVELSEETLVRTIGLANLEHYSSNFRDFELYGSPSYPAPAEEWELLGRFTADNAKHAQRFVLPDPRWTRYLRLRLATHYGSGFYCILSYLEVYGIDAVEQMLQEIISGSGADTDASAAAKAEEGGDGGTLRNDTAQVNARLDGVGGGGGSAAGRNDSAGDGAGAKNNGSRMTVAGDGKPAAAGRFHGDAVLKIMMQKMRSLELGLSTLEDYTKALNHRYGAKLPDLHTGLSQTTMALDRMKADVRDLVEWKGNVAKDLGELKEWRSNVEEMRSIQETMQNKELAVLSISLFFACLALFKLACDRVLFLFTRKGAAAAERMCGASKGWILVLASSSFTTFLVLLYN

SEQ ID NO: 29290 - protein, 131 aa, Methylococcus capsulatus
MQEPVIQTPYQRLGGEAVLHELVERFYGYMDELPEAAPIRAMHADDLSGAKSKLFKFLSGWLGGPDLFVQEFGHPRLRARHFPFSIGVPERDQWLLCMRKALDDIPLDGPFREALYEALARTAHHMINRED

SEQ ID NO: 29291 - protein, 217 aa, Oryza sativa
MGGRVDHEYSYLFKMVLIGDTGVGKSNILSRFTRNHFSLDSKSTIGVEFATKSLQMEGKTIKAQIWDTAGQERYRAITSAYYRGAVGALLVYDITKRQSFDNVHRWLRELRDHADSSIVIMMVGNKSDLIHLRAVSEDEGKALAEKEGLFFLETSAMEAVNVEEAFQTIITEVYGIVNRKALAAKEAAAASAPLPSQGKTISIDSAAGNTKRACCSA

SEQ ID NO: 29292 - protein, 443 aa, Salmonella enterica
IGVVGMAVMGRNLALNIESRGYTVSVFNRSREKTEEVIAENPGKKLVPYYTVKEFVESLETSRRILLMVKAGAGTDAAIDSLKPYLEKGDIIIDGGNTFFQDTIRRNRELSAEGFNFIGTGVSGGEEGALKGPSIMPGGQKDAYELVAPILTKIAAVAEDGEPCVTYIGADGAGHYVKMVHNGIEYGDMQLIAEAYSLLKGGLNLSNEELANTFTEWNNGELSSYLIDITKDIFTKKDEDGNYLVDVILDEAANKGTGKWTSQSALDLGEPLSLITESVFARYISSLKAQRVAASKVLSGPKAQLAGDKAEFIEKVRRALYLGKIVSYAQGFSQLPAASDEYHWDLNYGEIAKIFRAGCIIRAQFLQKITDAYAENAGIANLLLAPYFKKIADEYQQALRDVVAYAVQNGIPVPTFSAAVAYYDSYRAAVLPANLIQAQRDYF

SEQ ID NO: 29293 - protein, 113 aa, Lactococcus lactis
MKKIEAIIRTDKLEDLKAALSDNGLVHGMTVSQVLGYGEQKGFTEYVRGQRIETTLLSKLKIEIVSIDEKVDDIVNVIIKAVQTGEVGDGKIFIQPVERVIRIRTSEEDAQAL

SEQ ID NO: 29294 - protein, 415 aa, Triticum aestivum
  misc_feature (234)..(234): Xaa can be any naturally occurring amino acid
  misc_feature (242)..(242): Xaa can be any naturally occurring amino acid
MAAAAGGATTSTRRGPGGGGRPMDDENLTFETSAGVEVVGSFDAMGIREDLLRGIYGYGFEKPSAIQQRAVIPIITGRDVIAQAQSGTGKTSMISLSVCQVIETNVHEVQALILSPTRELATQTERVMQAVGNFMSVSVHACVGGKSIGEDIRKLESGVHVVSGTPGRVCDMIQRRTLRTRAIKLLVLDEADEMLSRGFKDQIYDVYRYLPPELQVVLISATLPHDILEITSKXFLTDPVRXILVKRDELTLEGIKQFFVAVEKEEWKFDTLCDLYDTLTITQAVIFCNTKRKVDWLTERMRTNNFTVSAMHGDMPQKERDAIMSEFRGGTTRVLITTDVWARGLDVQQVSLVINYDLPNNRELYIHRIGRSGRFGRKGVAINFVRKDDIRILRDIEQYYSTQIDEMPMNVADLI

SEQ ID NO: 29295 - protein, 477 aa, Oenococcus oeni
MTQADFGVVGMAVMGRNLALNVESRGYTVAIFNRSRSKTDDVMAKHSDKKLIPSFTIEDFVKSIAKPRRIMLMVKAGAGTDAVINELIPLLDKGDILIDGGNTFFKDTIARNARLADSGINFIGTGVSGGELGALKGPSLMPGGQKEAYELVRPIFEQIAAKATQDGKPCVTFCGENGAGHYVKMVHNGIEYGDEELIDETYNIMRNVLGLSVDEMADIFKEWNKGELDSYLIEITADILTRKDDLGSDKPIVDMILDRGNNKGTGRWSSGDALEVQVPQSVITEAVYARYISMMKDERVAASKVLNGPAKKVELPEDKKELVEKIRQALYFAKIMSYAQGFEQLRFAAKQYNWDFDYGKLAQIWRAGCIIRAGFLQNITDAYDKKPDLTNLLMDDYFKDIANKYQEAVRDVVALAVKAGVPVPALSAAVIYFDSYRSEVLPANLLQAQRDYFGAHTYQRVDKPFDQAFHYPWYAEG

SEQ ID NO: 29296 - protein, 443 aa, Salmonella enterica
IGVVGMAVMGRNLALNIESRGYTVSVFNRSREKTEEVIAENPGKKLVPYYTVKEFVESLETPRRILLMVKAGAGTDAAIGSLKPYLEKGDIIIDGGNTFFQDTIRRNRELSAEGFNFIGTGVSGGEEGALKGPSIMPGGQKDAYELVAPILTKIAAVAEDGEPCVTYIGADGAGHYVKMVHNGIEYGDMQLIAEAYSLLKGGLNLSNEELANTFTEWNNGELSSYLIDITKDIFTKKDEDGNYLVDVILDEAANKGTGKWTSQSALDLGEPLSLITESVFARYISSLKAQRVAASKVLSGPKAQPAGDKAEFIEKVRRALYLGKIVSYAQGFSQLRAASDEYHWDLNYGEIAKIFRTGCIIRAQFLQKITDAYAENAGIANLLLAPYFKKIADEYQQALRDVVAYAVQNGIPVPTFSAAVAYYDSYRAAVLPANLIQAQRDYF

SEQ ID NO: 29297 - protein, 676 aa, Hordeum vulgare
MFPLGARQPPPSAMDNHQQQQPPRGEHAAQPRCWEEFLHRKTIRVLLVETDDSTRQVVAALLRHCMYQVIPVENGHQAWAYLQDMQSNIDLVLTEVFMHGGLSGIDLLGRIMNHEVCKDIPVIMMSSHDSMGTVLSCLSNGAADFLAKPIRKNELKNLWAHVWRRSHSSSGSGSGSAIQTQKCTKSKSGDDSNNNSNDRNDDASMGLNARDGSDNGSGTQAQSSWTKRAVEIDSPQDMSPDQSADPPEGTCAHVNHPKSEICSNRWLPGTNNKKCQKPKETTNGDGFKGKELEIGAPGNLNTDDQSSPKESSVKPTDGRCEYLPHNNSSDTVMENLEEPIVRAADLIGSMAKNMDAQQAAARAIDAPNCSLQAPEGKDTDGENAMPYLELSLKRSRSTGEGAGPIQEEQRNVVRRSDLSAFTRYNMCAVSNQGGAGFVGSCSPNGDSSEAAKTVAAQMKQGSNGSSNNNDMGSTTKSVVTKPCGNNKVSPINGNTHTSAFHRVQPWTPATAAGKDKADEVSKKNVAAAAAAAKEMGCEAQSKHPCAAADDVNGGSAGGTAQSSVVNPSGPVEGHAANYGSNSFSNNNTNNGSTAATTAAAATVHAETGGGVDKRSNMMNMKRERRVAAVNKFREKRKERNFGKKVRYQSRKRLAEQRPRVRGQFVRQPPAPAAVER

SEQ ID NO: 29298 - protein, 448 aa, Unknown
  Mycobacterium sp. MCS
MNGLHENLQGIFEEVARRNPGETEFHQAVYEVLQSLGPVVAKHPEYADSAIIRRLCEPERQILFRVPWVDDSGAVQMNRGFRVEFNSALGPFKGGLRFHPSVYLGIIKFLGFEQIFKNSLTGMPIGGAKGGSDFDPKGRSNGEIMRFCQSFMTELYRHIGEYTDVPAGDIGVGMREIGYLFGQYKRITNRYESGVLTGKGITWGGSLVRTEATGYGTVYFIADILKSRGESFEGTRAVVSGSGNVAIYAIEKIQHLGGTVIACSDSDGYVVDPDGIDLALLKEVKEVQRGRVADYAEMRCGRARFVHGNVWDVECDIAVPSATQNEINGADAAALVKGGCRIVAEGANMPCTPEAVKLFAEAGTVFAPGKAVNAGGVATSALEMQQNASRDSWTFDETEDKLAEIMGRIHDRCLQTAEEYGQPGNYVAGANIAGFTRVADAMLALGII

SEQ ID NO: 29299 - protein, 443 aa, Salmonella enterica
IGVVGMAVMGRNLALNIESRGYTVSVFNRSREKTEEVIAENPGKKLVPYYTVKEFVESLETPRRILLMVKAGAGTDAAIGSLKPYLEKGDIIIDGGNTFFQDTIRRNRELSAEGFNFIGTGVSGGEEGALKGPSIMPGGQKDAYELVAPILTKIAAVAEDGEPCVTYIGADGAGHYVKMVHNGIEYGDMQLIAEAYSLLKGGLNLSNEELANTFTEWNNGELSSYLIDITKDIFTKKDEDGNYLVDVILDEAANKGTGKWTSQSALDLGEPLSLITESVFARYISSLKAQRVAASKVLSGPKAQPAGDKAEFIEKVRRALYLGKIVSYAQGFSALRAASDEYHWDLNYGEIAKIFRAGCSIRAQFLQKITDAYSENAGIANLLLAPYFKKIADEYQQALRDVVAYAVQNGIPVPTFSAGVAYYDSYRAAELPADLSQAQRDYF

SEQ ID NO: 29300 - protein, 854 aa, Oryza sativa
MASKGTEGGHGGVERKEQQQQRGYQLPRDSRGSLEVFNPSSASSFRTAAAAPKSASPFLAIPDREEDNVVAQQRAAEWGLVLQTDHHTGLPQGVSARPSSGSARTSSEDNPQQQQSAAAIPRVSEELRAALSAFQQTFVVSDATHPNHPIMYASAGFFNMTGYTSKEVVGRNCRFLQGSGTDPHEIDKIRQSLANGSNYCGRILNYKKDGTPFWNLLTIAPIKDEDGRLLKFIGMQVEVSKYTEGKKDTVVRPNGLSESLIKYDARQKDHARSSVSELLLALKNPRSLSESSNNTLKRKSQESLSMSMTEVPSKRSSESGSRRNSRSGTRSSLQKINEVPDQGNRTRKSGLRAFMGFLGMGHGSVEKNMLKPRDEDPLIDSDDERPESFEDEFRRKEMRRGIDLATTLERIEKNFVITDPRLPDNPIIFASDSFLQLTEYNREEILGRNCRFLQGPETDRATVRKIRDAIDNQAEVTVQLINYTKSGKKFWNLFHLQPMRDQKGDVQYFIGVQLDGTEHVQDDAAKEGVVLVKKTADNIDEAAKELPDANLRPEDLWANHSKVVLPNPHMKDTASWRAIQKVLESGESIGLKHFRPVKPLGSGDTGSVHLVELLNTGEYFAMKAMDKSIMLNRNKVHRATAERQILDLLDHPFLPTLYASFQTKTHICLITDYCPGGELFVLLDNQPLKVLHEDAVRFYAAEVVVALEYLHCQGIIYRDLKPENILLHRDGHISLTDFDLSCLTSCRPQVFLPEDADEKKGRKNGSYPIFFAEPMRASNSFVGTEEYIAPEIITGAGHTSAVDWWALGILLYEMLYGYTPFRGKTRQRTFANILHKDIRFPASISVSKSSVIFF

SEQ ID NO: 29301 - protein, 434 aa, Mannheimia succiniciproducens
MNNAVLNQPNKYDLVKDTLVLILAGGRGSRLHELTDKRAKPALYFGGNRRIIDFALSNCINSGLNRIGVITQYAAHSLLRHLQTGWSFLPQERGEFVDMLPARQQIDDNTWYRGTADSVYQNLAIIRGHYKPKYVLILAGDHIYKMDYSQMLLDHVSSGAKCTVGCIEVPREEAKEFGVMAVNETLKVKAFVEKPQDPPAMIGKPNSSLASMGIYVFNADYLYEALDRIKTPNTSHDFGKDVMPLALNDGVLYAHPFDRSCKGRNTEGAIYWKDVGTLDSFWQANIDLVSEEPQLDIYDQTWPIRGNPVQAYPSKFFYDEPNCKQVDNSLIAGGCMVKNASISYSVLFDNVSVNAGSSIEQSVILPQVKIGKNCMLRRCIIDRHVQIPDGMQIGVDLELDSKRFRISKNGIVLVTESMLHKLNGKSVASEAHLD

SEQ ID NO: 29302 - protein, 443 aa, Salmonella enterica
IGVVGMAVMGRNLALNIESRGYTVSVFNRSREKTEEVIAENPGKKLVPYYTVKEFVESLETPRRILLMVKAGAGTDAAIDSLKPYLEKGDIIIDGGNTFFQDTIRRNRELSAEGFNFIGTGVSGGEEGALKGPSIMPGGQKDAYELVAPILTKIAAVAEDGEPCVTYIGADGVGHYVKMVHNGIEYGDMQLIAEAYSLLKGGLNLSNEELASTFTEWNNGELSSYLIDITKDIFTKKDEDGNYLVDVILDEAANKGTGKWTSQSALDLGEPLSLITESVFARYISSLKAKRVAASKVLSGPKAQPAGDKAEFIGKVRRALYLGKTVSYAKGFSQLAARSDEYHWDLNYGEIAKIFRAGCIIRAEFLQKITDAYAENAGIANLLLAPYFKKIADEYQQALRDVVAYAVQNGIPVPTFSAAVAYYDSYRAAVLPANLIQAQRDYF

SEQ ID NO: 29303 - protein, 1230 aa, Cryptococcus neoformans
MSSFTPAFRLHHTHSSSVSPTASNDVAPSSPTPNQPHQLAARSPLYATSPNCASKITKGSSLSSSTAHHGLKYVRPSTSPLLRSPKGESFSAYLGNWGSQELITFLNIHKCGQYLAIFQKNDINGKILLDLDMTALKSMGIGKISERVRLIGGIKDLRRCVADESIRAPFTQRSYPSERTLLPSLPSHSNVLLDKWDCSSSASRLGKRQITLRPPPLDLQGHMPPRLLSHASLGIATIDTHDIHTTNSKIEVYIQQNPPGQPQSMPTKRSDSLTLCAAPSRNVGRRSPSSRHFEGCKSQTDGLTTLNLTLDRQVPSSTMNNVTLREDCHLQREERLPLSHQVPHSRNAFASPHKTSLSGRCPLARGDTTSHQPSGPAIAEQDSPVNYRISNTVTNTKEISQGDLKQPFVMKSLESQSHLLAGVSDMSHDPVTDGFKPKGKASVPLTVMSSSDISAVNANPAALSLADLRRQLVKFINTEDDTIRTVNVMHVTSGVEILERALKKFGKFGTGIHGSPDVYGDEDGDGTLEIDGWEVYTESTPDESSKPLSEFNLLKTCTFHREGTAIQDKGLFLRKKQRMQKRKNIQDFFGETPPPSMSPTSPTLITGPHLSLVQGKSQPTSGSAFSSSSRLSTLTHKGRNRASMISVMSGLGVPIINTLPSPQGNGLRLTGSVHSHEKKSMYNFFGHRPPSELISNHLTDYFPSAKKSDVEKARHSLLRLSGGTVAYKKSGIYEGDSTPDHWSKPGDNQPPSLPPFEPSQDTLSDSLQAFASSTPVHLSRPKHTVALRRRRDSDSSSRSHTSMLMQTRRNRDHSDTTSLLTVDEITAEVENRRVSTIQRGDYIEETEDSSSIEGDTLPQDDESKGVLRAICSDSNKLVDSGKSYQGDSDIDQQHELEDEEEDKLDDDEEEEEEEEEEDNEQGKAFTSTGSKRIIKWIKGALIGAGSFGSVYLGMDAQSGLLMAVKQVELSAGSAKNEDRKRSMLSALEREIELLKELQHENIVQYLDSSVDANHLNIFLEYVPGGSVAALLNNYGAFEEALVRNFVRQILTGLNYLHMRGIVHRDIKGANILVDNKGGIKISDFGISKKVENSLITGLRTNRPSLQGSVFWMAPEVVKQTSYSPKADIWSVGCLVVEMLTGTHPWADLTQMQAIFRIGSLARPAPPSDISVQADEFLRKTFEIEHAKRPTAAQLLKHPFIGSPRVRTAASNFINGAIASETMEVQVVEES

SEQ ID NO: 29304 - protein, 661 aa, Mannheimia succiniciproducens
MLKNQTGKPYPLGATLVEVNGTKGVNFSIFSASARAIELCLFDNSGREVRFPILDKTDDIFHIWVPNVPLGTKYGFRIHGDERHNPKKLMLDPYAKMVVGKPDLTSKENQAWYLLSDERDNSKIAPKSIIIDGEFDWEQDKPLNIPWTETIIYELHVKGFSKLRADLPEEIRGTYSALAHPSVIAYLKELGITAVELLPINFSISESHLQERGISNYWGYNPMAMFAVEPQYAATEDPVHEFKTMVKTLHQAGIEVILDMVFNHSAESERDFPTFSYRGIDEQTYYWSDAQGNYLNWSGCGNLLHLAHPYMRRWAIDCLRYWVEEYHIDGFRFDLATNLGRETPAYKAHSELFKAMRLISGFKNTKFIAEPWDMGEDGYQMGNFPPFFAEWNDRFRDDINRFWLWQSGELGAFAERFAGSADIFKQEGKYPHNSVNFITAHDGFTLRDLVSYNHKHNNANGEDNRDGRNENYSHNHGIEGSTDGLDEPQKTAVENARILSSQSLLCSLLLSNGTPMLLAGDEFGNTQFGNNNGYCQDSGLTWLKWSNFNLDLFEIVKKLIIVRKGIQSLVNDKWWTEGNVRWFNEFGSLMNVSDWQERGAKALQVLLDEQWLCVVNAKTELQVFSLPEGDWNMEISMTGCKNQNNQLIVDNLSFCLLRRIL

SEQ ID NO: 29305 - protein, 443 aa, Salmonella enterica
IGVVGMAVMGRNLALNIESRGYTVSVFNRSREKTEEVIAENPGKKLVPYYTVKEFVESLETPRRILLMVKAGAGTDAAIDSLKPYLEKGDIIIDGGNTFFQDTIRRNRELSAEGFNFIGTGVSGGEEGALKGPSIMPGGQKDAYELVAPILTKIAAVAEDGEPCVTYIGADGAGHYVKMVHNGIEYGDMQLIAEAYSLLKGGLNLSNEELANTFTEWNNGELSSYLIDITKDIFTKKDEDGNYLVDVILDEAANKGTGKWTSQSALDLGEPLSLITESVFARYISSLKAQRVAASKVLSGPKAQPAGDKAEFIEKVRRALYLGKIVSYAQGFSQLRAASDEYHWDLNYGEIAKIFRAGCIIRAQFLQKITDAYAENADIANLLLAPYFKKIADEYQQALRDVVAYAVQNGIPVPTFSAAVAYYDSYRAAVLPANLIQAQRDYF

SEQ ID NO: 29306 - protein, 236 aa, Zea mays
MAGGGDDELKLLGAWASPFVLRVKLALSFKGLSYEDVEEDLSGGKSELLLESNPVHKKVPVLLHNGKPVCESQIIVQYIDEAFAGTGPSLLPADPHQRAVARFWGAYIDDKLLAFWLQSARAKTQEEKAEALKQALAAAENLEAAFTEISEGKPFFGGDSVGYLDVTLGALVAWVHAAEKLYGMRLFDATRTPRLSAFVERFGALGAAKAVLPDVDGLVEYAKQRQADAAAAASDS

SEQ ID NO: 29307 - protein, 321 aa, Thermosynechococcus elongatus
MNIAPDITALIGRTPLVRLNRIPQAEGCVAEIVVKLESMNPAASVKDRIGLSMIQEAEAAGLITPGKTVLVEPTSGNTGIALAMVAAAKGYRLILTMPETMSAERRAMLRAYGAELDLTPGTEGMSGAIRRAEEIAASLEDAFMLQQFKNPANPKIHRETTALEIWQDTDGQVDILVAGVGTGGTITGVAEVIKAKKPTFQAIAVEPSNSPVLSGGKPGPHKIQGIGAGFVPPVLKRELIDEVIPVSDDQAIHFGRRLAREEGLLSGISSGAALCAAIQVAQRPENAGKLIVMVQPSFGERYLSTPLFQEALPLVPSYLQT

SEQ ID NO: 29308 - protein, 583 aa, Magnaporthe grisea
MCGIFACHAHPDVQKFKPTALRLAKAIRHRGPDWSGSVTCNQTILCHERLSIVGVESGAQPLTNEDESIILAVNGEIYNHRLVRKSLKTPYHFKTTSDCEVIIPLYMEHGLDAPKYLDGMFSFVLYDKKQNRTIAARDPIGVTTFYQGWSSSEPGAVYFGSELKCLYQVCDKIEAFPPGHIYDSLTGERTRYFQPTWWDPKRVPETPLDLTKLREALEKSVRKRLMAEVPYGVLLSGGLDSSLVASIAQRETKRLKKLAIEAGLEDLPAEPTGNHDQGEGLVGIDDENKLSTMTYLPQLNSFSIGLPGSPDNKAALEVAKFLGTKHHVMTFTIEDGLNALSDVIYHLESYDVTTIRASTPMYLLSRKIKAMGIKMVLSGEGSDEAFGGYLYFHNAPDKDAFHDETVRRVKNLHLSDCLRANKSTSAWGLEARVPFLDKEFLELAMNIDPKEKMITKERIEKYIVRKAFDTSDDPNAEPYLPDNILWRQKEQFSDGVGYGWIDALKDNAEIQVTDEMMKNPKPEWGDDIPDTKEAYWYRCMFDEHFPPHCASTVERWTPTWSKQTDPSGRAIAVHAAKYDHISE

SEQ ID NO: 29309 - protein, 297 aa, Unknown
  Mycobacterium sp. JLS
MQLGLVGLGKMGFNMRERLREGGHEVVGFDPRPEVTDVPSLAALADALAAPRVVWVMVPSGPVTHDTIVSLAEVLGEGDLVIDGGNSRFTEDAPHAELLKAKGIGFIDAGVSGGVWGLAEGYGLMVGGDDADIERVMPIFDTLRPPGDRADGFVHAGPVGAGHFAKMVHNGVEYALMTAYGEGYELLAAEELIRDPQAVYQAWTNGTVVRSWLQQLLAKALREDPGLAEISGYTEDSGEGRWTVEEAIRLRVPVPSIAASLFARFESRQEDSPTMKAVSALRNQFGGHAVQRISKSG

SEQ ID NO: 29310 - protein, 438 aa, Treponema denticola
MKKTDFSISTLGECKIQSPIMLSETHGDLIANYVTDNEFIRYNLDASLGETGEPLTHADIIEKAGPRQKIYFSPNYVHAAIATCGGLCPGINDVIRAIVRCLWTRYGVRRISGIKFGYKGFISEYGFSPVPLTPEAVNGIHKTGGSFLGTSRGGGTRVTEIVDGIEQMNINMVFFIGGDGTQKGALEVSREIERRKLKISVIGIPKTIDNDLSFIQKSFGFDTAIAKATESVAAANMEASSQINGIGLVKLMGRESGFIATHTAIACHEAHFVLIPEVRFELGGENGFLKLLEKKLIENGYALIVAAEGAGQHLMNIEEETDASGNKKLADIGLFLKKEITEYFDKIGMHINLKYIDPSYQIRSSIAAPIDSVYCERLGNNAVHAAMAGKTRTLIGLVNNKFVHLPIEQVVSERKYVNPESSLWRDALDATGQPTTMI

SEQ ID NO: 29311 - protein, 77 aa, Asarum canadense
MKEQKLIHEGLIIESLPNGMFRVRLDNEDLILGYVSGRIRRSFIRILPGDRVKIEVSRYDSTRGRIIYRLRNKDSND

SEQ ID NO: 29312 - protein, 454 aa, Arabidopsis thaliana
MEGRRITASPRPCSGRRIVAKKRSRPDGFVNSVKKLQRREISSRKDRAFSISTAQERFRNMRLVEQYDTHDPKGHCLVALPFLMKRTKVIEIVAARDIVFALAHSGVCAAFSRDEVIRSLFYNKNNDSLITVSVYASDNFSSLKCRSTRIEYILRGQPDAGFALFESESLKWPGFVEFDDVNGKVLTYSAQDSVYKVFDLKNYTMLYSISDKNVQEIKISPGIMLLIFKRAASHVPLKILSIEDGTVLKSFNHLLHRNKKVDFIEQFNEKLLVKQENENLQILDVRNAELMEVSRAEFMTPSAFIFLYENQLFLTFRNRNVSVWNFRGELVTSFEDHLLWHPDCNTNNIYITSDQDLIISYCKADTEDQWIEGNAGSINISNILTGKCLAKITPSSGPPKDDESSSSNCMGKNSKQRRNAVAEALEDITALFYDEERNEIYTGNRHGLVHVWSN

SEQ ID NO: 29313 - protein, 464 aa, Pseudomonas syringae
MEFLPLFHNLRGSRVLVVGGGEIALRKSRLIADAGAVLRVVAPEIETQLRELVAHSGGELILRGYSESDLDGCVLIIAATDDEPLNAQVSRDARLRCVPVNVVDAPALCTVIFPAIVDRSPLVIAVSSGGDAPVLARLIRAKLETWIPSSYGQLAGLAARFRNQVKGLLPNVQQRRAFWEEVFQGAIADRQLAGQGAEAERLLIAKIAGEPPAQTGEVYLVGAGPGDPDLLTFRALRLMQQADVVLYDRLVAPTILDLCRRDAERVYVGKRRAEHAVPQEQINQQLVALAKQGKRVVRLKGGDPFIFGRGGEEIEELAAHGIPFQVVPGITAASGCAAYAGIPLTHRDHAQSVRFITGHLKNGTTDLPWSDLVAPAQTLVFYMGLIGLPVICAELIKHGRSADTPAALVQQGTTVNQRVFTGTLANLPQLVAEHEVHAPTLVIIGEVVKLREKLAWFEGAQATL

SEQ ID NO: 29314 - protein, 435 aa, Unknown
  Burkholderia sp. 383
MPPSAARFSSHTMDIDQYMTDLGRRARHASRAMARASTAAKNAALDAVARAIERDAQVLKDANARDVARAREKGLDAAFVDRLTLSDKALNTMVEGLRQVASLADPIGEISNLKYRPSGIQVGQMRVPLGVIGIIYESRPNVTIDAAALCLKSGNATILRGGSEALESNTALAKLIGEGLEAAGLPQDAVQVVATADRAAVGKLITMTEYVDVIVPRGGKSLIERLINEARVPMIKHLDGICHVYVDDRADLAKALTVCDNAKTHRYGTCNTMETLLVSSGVAAKLLPPLGKLYRDKQVELRVDAAARTVLADAGVGPLVDATEEDWHTEYLAPVLAIKVVDGLDAAIEHINHYGSHHTDAIVTEDHDRAMRFLREVDSASVMVNASTRFADGFEFGLGAEIGISNDKLHARGPVGLEGLTSLKYVVLGHGEGRQ

SEQ ID NO: 29315 - protein, 417 aa, Serratia marcescens [sequence omitted]

SEQ ID NO: 29316 - protein, 459 aa, Bacillus thuringiensis
MIQKQHESKLEVGQTFPVTIKRLGINGEGVGYFKRQVVFIPGALPGEEVVAETTKIQRGFAEAKVKKVRKASPHRVKAPCPVYEECGGCQLQHLDYKEQLNQKRDIVVQAFEKYMKNSMEEKIRPTLGMENPWHYRNKSQLQVGRKDEKVITGLYKQNSHQLIDIAHCMIQHKATNEATKVVRRILEKLNVSIYNEKKQKGLVRTIVTRTAVQTGEVQVTLITTKEELPNKEQFIAEVQKQMPAVKSIMQNVNWRKTSVIFGDKTFKLAGKEVIQETLGDLSFELSARAFFQLNPEQTVVLYNEAKKAAALTGNEKIVDAYCGVGTIGLWLANDAAEVRGMDVIPEAIADARKNAKRHGFTNTKYEAGKAEQWLPKWVKEGWRPDVIVVDPPRTGCDDKLLETILKVKPKQVVYVSCNPSSLARDVQALMKSYEVEYVQPVDMFPHTAHVENVVKLVRK

SEQ ID NO: 29317 - protein, 516 aa, Oryza sativa
MGMEVAAARLGALYTTSDYASVVSINLFVALLCACIVLGHLLEENRWVNESITALIIGLCTGVVILLMTKGKSSHLFVFSEDLFFIYLLPPIIFNAGFCLLEFYSWSIYSAAIAIFSRMNIGTLDVGDFLAIGAIFSATDSVCTLQVLNQDETPFLYSLVFGEGVVNDATSIVLFNALQNFDLVHIDAAVVLKFLGNFFYLFLSSTFLGVFAGLLSAYIIKKLYIGRHSTDREVALMMLMAYLSYMLAELLDLSGILTVFFCGIVMSHYTWHNVTESSRVTTKHAFATLSFIAETFLFLYVGMDALDIEKWEFASDRPGKSIGISSILLGLVLIGRAAFVFPLSFLSNLTKKAPNEKITWRQQVVIWWAGLMRGAVSIALAYNKFTRSGHTQLHGNAIMITSTITVVLFSTMVFGMMTKPLIRLLLPASGHPVTSEPSSPKSLHSPLLTSMQGSDLESTTNIVRPSSLRMLLTKPTHTVHYYWRKFDDALMRPMFGGRGFVPFSPGSPTEQSHGGR

SEQ ID NO: 29318 - protein, 358 aa, Saccharophagus degradans
MLQLLVEFFSLTENQAYNNMSSKYTVTVLGGGSFGTAVANIIATNGHVSRLWMRDAARAERCQASRENTEYLPGYPLHDNLVATTDLIGSVSTSDIVVISVPSQSFREVAKLAAPHLRKDTIVISTTKGIDADGFFLMSQILEQELTDVRIGVLSGPNFAKEIVQNQYTGSVVASEHDEVLKCVQQVFSSNTFRIYSNPDRYGVELGGALKNIYAMVTGMAAALGCGHNTMAMLLTRSLAEMGRFARELGADSMTFLGLAGMGDLVLTCTSDLSRNYRVGFAVGRGKSLEQAVQEIGQVAEGVNTLRIVKKKAEELNVYMPLVDGLHAVLFDKQDLQQVIQGLMTGEMSSDVDLQGGL

SEQ ID NO: 29319 - protein, 612 aa, Geobacter metallireducens
MGEWHLDMGATPLAGGVRFRVWAPLAESVAVIPCGKEASYPLSRAGEYFQGTIAGMAPGDRYWYLLDGTLRRPDPASRSQPDGVHGPSQVVAPVSFCWTDGQWRGLKLEELITYELHVGTFTPVGTFTAAIRRLDYLAELGVTAVELMPVAEFPGTRNWGYDGVFPFAPHHAYGGANGLKALVDACHRRGLAVILDVVYNHLGPEGNYLHPFAPYFTDRYRTPWGDAVNFDGPDSNGVRHYVIANALHWVSEYHVDGLRLDAIHGIYDFSARHILLDISQAVDSLARQLGRKVHVIAESDLNDVRTITPPEWGGHGCHAQWCDDFHHGLMTYLTGERQGYYADFGLFGHLEKAFREGFVYSGQYSRHRRRRHGSPSAARPPRQLVVFSQNHDQVGNRLRGDRPSLRLSLEQLKLAAGAVILSPYLPLLFMGEEYSETAPFPYFTSHGDPELAEAVRQGRREEFASFGWEAEVPDPQAEETFLAARIDPERRHQGWHRSLYAFYREVIRLRRELPHLRHPEREEVAVVGLEADRVIALRYRHGGRELITLFALGKTPRTVRLPFRHGECRKLLDSAGKSWGGPGSIAPERIGADGDGAGLTLAPFSVTLYGTG

SEQ ID NO: 29320 - protein, 1182 aa, Cryptococcus neoformans
MFVTRPPSSSVDHRGSLLDGHTNHTNTPGSSRDDVPSSDSTSTAFHKFKNSSRFSPHYLNIPPGLAFKSYLEKWGPEQVIGFLAIHGCEHHSGIFIKNSIDGKLLLDLDMGILTSLGITKVGERIRLMAGIKCLRQRVAHEAEKHNIPSAHLCNGSLEMDRVKVIIHPKLSASLYVHRHGPFDSGPITARRCPLTPSSSADPEGDPSPMQRSQEVMKHSFITRSSRRQVIPPLPPGQIHNHGIDNSPMPSLRHIPLRSGVSYSDIDVKGMPPLVTQSTNSVFNHTFAVTGSHDTTSCLGGHLRRPDYFRSTNDTFQTCTKRGDNTISELPQRNQESSPSMWKQSGVICEDKAMRNGSLFAPTSHKPFAISITGDNVMEYPHNLPIKNGLPLRSFQSPDKSADDDRLNINPSAPSLDDLRRQLVKFVNAEDGTTRTVNVMKTTSGVEVLERALRKFGKTGTGRALLLDDESHNGGKHEGPLCIDGWGVFAENLQGEEMGPMSEEDLLDICASLRNGAAMQRDALILRQTSKSQKRKDMRFYLGSMPVLPTPVNLPISFSSSHSGQFEQNSALQYTAQHQPLRSKNRSRASMMSIMSGLGVSHPDIKQPTHDSLQSPASVTMPSSKKKSMYNFFGHRPPSELISSHLTDYFPSAKKRDVAKARGSMLRLNIAHSAERNPRSVENLGMIEADDVPFSSTEQSLTEQRDHYFDSSTCQPADTSSPGHVDHNITDPAGNSEGNYRLPYDQKVLPTPITQELHSANSVNPILRTYPPNLPSTYLSARLTDLHRDSFLSQLQPLQHSSSLSSAQPFSSHRRTVDEITAEMQHRQTSLSCDRPTSTIDSDISGPPCNSEISLDHTSEASGISESSSEYCDDHSSVSSEDSEDNSAAHTRAFTTKRNIKWIKGALIGAGSFGSVFLGMDAQSGLLMAVKQVELPRGIAKMEARRRDMLSALEREIELLKDLQHDNIVQYLDSSMDANHLNIFLEYVPGGSVAALLNNYGAFEEALAGNFVRQILTGLNYLHERDIVHRDIKGANILVDNKGGIKISDFGISKKVENSLLNGLHPNRPSLQGSVFWMAPEVVKQTSYTSKADIWSVGCLVVEMLTGTHPWARLTQMQAIFQIGSMGQPEIPSDISVHAADFLSRAFALDYRMRPSAASLLKHAFMVHDGNGGNDEPIQNTYA

SEQ ID NO: 29321 - protein, 1112 aa, Geobacter metallireducens
MARREPLRGGNPLWYRDAIIYQLHVKAFADSDGDGMGDFRGLMGKLDYLQSLGITAIWILPFYPSPLRDDGYDIADYYSVNPSYNTLREFREFLRAAHARRIRVITELVLNHTSDQHPWFQRARRAKPGSAHRDYYVWSDNPDRYQGTRIIFQDFETSNWSWDPVAKAYYWHRFYSHQPDLNYDNPKVQAEMLRVIDYWLGMGVDGVRLDAVPYLFEREGTNCENLPETHAFLKKLRAHVDASFPNRMLLGEANQWPEDAIAYFGEGDECNMLFHFPLMPRMYMAIEMEDRFPVIDIIDQTPAIPEGCQWAIFLRNHDELTLEMVTDEERDYMYRIYAADPKARINLGIRRRLAPLMERDRRKIELMNALLFSLPGTPIIYYGDEIGMGDNYYLGDRNGVRTPMQWSPDRNAGFSGANPQRLYLPVIIDPEYHYEAVNVEIQERNPTSLLWWMRRTIAVRRRHRAFSSGTLEMLYPANHRVLAFLRRHEDEVILVVGNLSRFAQAVSLDLKEFAGISPADLFSRNRFPVIREIPYPLTLGPHDHFWFILSRAESPRLPEGELPRINLPGGLPWWEALQHTGGDTRLERATTDYLNRSGWFRGKARAIIGYALRDTVLLRTSDQVFPLFFLEVRYQNGAPETYLIPVAFLRGPGAKRVDAESPQAAIASLSVGDEAGILCDALHDREFRDALLALALGRRRLHGKRESLVVPLHGRGGHAEGMRETEHLISELVTGEEASSVILYGDRHVFKLYRTVEPGVNSEVELVRFLTEKSRYPNIVPFQASLELRHPGTEPCTIGLVQEYVKNQGNGWRLALHLLGQYFERILSRRGEIPPPPKRFSSLIDGSACTVPEPVANLIGGFYLEMAGLLGRRTAELHLALAAGGNDPAWKPEAYSTIYQRSVYQSMRNQARRTLQLLSQNRNLLPIDDQGPADRVLGAEKEILSWLAQIVGRRIGTMKIRIHGNFHLGKVLFTGKDFVILDFEGEPDRTLSERRIKRSPLRDVASMIRSFHAATLTALARHGNGRSGDVQLLEPWADACYYHVSCRYLAGYLERMGNSPLVPADRNDLATLLRSFLLDRALRDLGFALGNRPETASSPLKGIETVLREYGE

SEQ ID NO: 29322 - protein, 313 aa, Cercocarpus betuloides
GGLGDVLGGLPPAMAANGHRVITISPRYDQYKDAWDTEVIVELKVGDKTEKVRFFHCYKRGVDRVFVDHPLFLEKVWGKTASKIYGPITGEDYQDNQLRFSLLCQAALEAPRVLNLTSNKYFSGPYGEDVVFIANDWHTALLPCYLKANYKPKGIYKSAKVAFCIHNIAYQGRFAFADFAFLNLPDGFKSSFDFIDGYEKPVKGRKLNWMKAGILESDKVLTVSPYYAKELASTVEKGVELDNIIRKTGIQGIVNGMDVQEWNPLTDKYTTVKYDASTVVDAKPLLKEALQAEVGLPVDKTVPVIGFIGRLEE

SEQ ID NO: 29323 - protein, 367 aa, Serratia marcescens
MNGSQTLVVKLGTSVLTGGSLRLNRAHIVELVRQCAQQHAAGHRIVIVTSGAIAAGREHLGYPELPATIASKQLLAAVGQSRLIQLWEQLFSIYGIHVGQMLLTRADLEDRERFLNARDTMTALLDNRIVPVINENDAVATAEIKVGDNDNLSALAAILAGADKLLLLTDQQGLYTADPRNNPQAELIREVHGIDDALRAIAGDSVSGLGTGGMGTKLQAADVACRAGIDVVIAAGSKPGVVADVIEGKPVGTRFHALETPLENRKRWIFGAPPAGEITVDDGAVEAMMARGSSLLPKGIREVKGDFSRGEVIRIRNLTGRDLAHGVSRYNSDAMRMIAGHHSQEISEILGYEYGPVAVHRDDMIVS

SEQ ID NO: 29324 - protein, 82 aa, Fusobacterium nucleatum
MNFCSMGGKMSKKDVIELEGTIVEALPNAMFKVELENGHTILGHISGKMRMNYIKILPGDGVTVQISPYDLSRGRIVYRKKN

SEQ ID NO: 29325 - protein, 313 aa, Chamaebatia foliolosa
GGLGDVLGGLPPAMAANGHRVITVSPRYDQYKDAWDTSVLIEFEVGGRTETVRFFHCYKRGVDRVFLDHPWFLEKVWGKTGSKIYGPRAGKDYKDNQLRFSLLCKAALEAPKVLNLNSNQYFSGPYGDDVIFIANDWHTALLPSYLKTFYKPKGIYKNAKVAFCIHNIAYQGRFPFADFSLLDLPDQLRSSFDFIDGYNKPAKGRKINWVKAGILESDRVITVSPYYAQELVSGEDKGVELDNIIRKTGITGIVNGMDVQEWNPATDKYLDVKYDATTVLDAKPLLKEALQAEAGLPVDRNVPVIGFIGRLEE

SEQ ID NO: 29326 - protein, 127 aa, Oryza sativa
TDEFNFTPCGYSMNGLVDETYSTIHVTPEAHCSYASFETNWNLSTYKRAIGRVFELFQPGTVTLTLFSDSTSASRSMDLVEIPGYVMTYKTHCEMESNRDVVLIQYDSFEHHNARQKNKLPVRNVCS

SEQ ID NO: 29327 - protein, 534 aa, Solanum lycopersicum
MGLDAVARLGVSILSDGDQVSVDSITLFVALLCGCIVIGHLLEESRWINDSITTLVIGLSTGGIILLTTKGKSSHLLEFDEQLFFIYVLPPIIFNAGFQVKKKQFFRNFVTIMLFGAVGTLISFSIISFGAKELLGKLDIGFLELRDYLAIGAIFSATDSVCTLQALNQDETPRLYSLVFGEGVVNDATSVVLFNAIQKLDLSHINSRAALVFTGNFLYLFLASTFLGVLIGLLSAYLIKKIYLGRHSTDREVALMILMAYLSYVMAELFDLSGILTVFICGIVMSHYTWHNVTFNSKVTTRHAFATLSFIAEIFIFLYVGMDALDIEKWRFVKDSPGKSVGVSAALLGLVLVGRACFVFPLSLFSNCLKRSEHDKFGLKLQVTIWWAGLMRGSVSMALAYNQFTRFGHTQQPGNAVMITSTITIVLFSTVVFGLITKPLVRFLLPSSQGFNNLISSEQSFARPLLTNEQELELEMGNVDPVRPSGLSILLKEPSYTIHNHWRRFDDAFMRPLFGGRGFVPDAPELSKGGCDQY

SEQ ID NO: 29328 - protein, 545 aa, Fusobacterium nucleatum
MERIYDMIVIGGGPAGLSAGIYGGRAKLDVLIIEKENKGGQISLTSEVVNYPGILEISGSEFMTQTKKQAQGFGVNFVQEEVLDMDFTEKIKTIKTNNAEYKTLSVVIATGAAPRKLGFPGEQEFTGRGVAYCATCDGEFFTGMDIFVIGAGFAAAEEAMFLTKYGKSVTIIAREPDFTCAKLIGDKVKAHPKITVKFNTELTELTGDVKPTAAKFKNNVTGEITEYKAKVGETFGVFVFVGYAPSSQIFKGHIEIDKAGFIPTNEDLMTNVDGVFAVGDIRPKRLRQVVTAVADGAIAATSIEKYVHDLREELGIKKEEKKEEKTTSVTTEKEHFLDNELRQQLVAVVDRFENPVEIVVFKDPNNEESVNIENAVKDIASISPEKLKFSSYNEGENKELETKVKVTRTPTIAILDKDGNYTGLKYSSLPSGHELNSFILGLYNVAGPGQKVATESLEKIEKINKPVNIKIGISLSCTKCPKTVQATQRIATLNKNVEMEMINIFTFQDFKNRYDIMSVPAIIVDDQHIYFGEKTVEDMLEIINK

SEQ ID NO: 29329 - protein, 308 aa, Lactococcus lactis
MTEKKYDVVIIGSGPAGMTAAMYTARSEMKTLLLERGVPGGQMNNTAEIENYPGYETIMGPELSMKMAEPLEGLGVENAYGFVTAIEDHGDYKKIITEDDEFVTKSIIIATGANHRKLEIPGEEEYGARGVSYCAVCDGAFFRNQEILVIGGGDSAVEEALYLTRFGQSVTIMHRRDKLRAQEIIQQRAFKEEKINFIWDSVPMEIKGDDKKVQSVVYKNVKTGEVTEKAFGGIFIYVGLDPVAEFAGNLGITDEAGWIITDDHMRTSLPGIFAVGDVRQKDFRQITTAIGDGAQAAQEAYKFVAELD

SEQ ID NO: 29330 - protein, 444 aa, Neisseria meningitidis
MTDLNTLFANLKQRNPNQEPFHQAVEEVFMSLDPFLAKNPKYTQQSLLERIVEPERVVMFRVTWQDDKGQVQVNRGYRVQMSSAIGPYKGGLRFHPTVDLGVLKFLAFEQVFKNALTTLPMGGGKGGSDFDPKGKSDAEVMRFCQAFMTELYRHIGADTDVPAGDIGVGGREIGYLFGQYKKIRNEFSSVLTGKGLEWGGSLIRPEATGYGCVYFAQAMLQTRNDSFEGKRVLISGSGNVAQYAAEKAIQLGAKVLTVSDSNGFVLFPDSGMTEAQLAALIELKEVRRERVATYAKEQGLQYFENQKPWGVAAEIALPCATQNELDEEAAKTLLANGCYVVAEGANMPSTLGAVEQFIKAGILYAPGKASNAGGVATSGLEMSQNAIRLSWTREEVDQRLFGIMQSIHESCLKYGKVGDTVNYVNGANIAGFVKVADAMLAQGF

SEQ ID NO: 29331 - protein, 313 aa, Chamaebatiaria millefolium
GGLGDVLGGLPPAMAANGHRVITVSPRYDQYKDAWDTCVLVELEVNGRTETVRFFHCHKRGVDRVFVDHPVFLERVWGKTGSKIYGPKAGEDYKDNQLRFSLLCQAALEAPRVLNLNSNEYFSGPYGEDVVFIANDWHTALLPCYLKTIYKPKGIYKSAKVAFCIHNIAYQGRFPFSDFSLLDLPDQLKGSFDFIDGYNKPVKGSKINWMKAGILESDRVVTVSPYYAQELVSGEDKGVELDNIIRKTGITGIVNGMDVQEWNPATDKYLDIKYDNTTVLDAKPLLKEALQAEVGLPVDRNIPVIGFIGRLEE

SEQ ID NO: 29332 - protein, 474 aa, Aquifex aeolicus
MKVVIVGNGPAAASAVEAFRKVDRDSEIIILSDEEFPTYAPNCMENVIRDDISKEALFYKGGEKFYEKYRVDFRPKTEVVGIDNKRKVVITKKGEEISYDKCLLAAGAYSFIPPIDGVDLERVTTAKNLYDAYKIRSWILSGKITKAVIIGAGPIGIEDAETLRHMGIDVTVIEVFDRILPRMLDRQMGKLYQKPLEEEGIEFLLEHQVVAIHGKNGEVEAVEVKKRGTDKTFFIKTDMVIISTGVRPRTYLVEGTDIEIHMDKKLNKPIGGILVNEYQQTSDPDVYAAGDIASGVDMWGNHRWIALFPPAQQAGYVAGFNMAGLKVRNNGLVDYNAVKTRSVTAGSGGLFEDADESFFLEYKEYLVKVFLKDGKVRGYQFVGVPKYPKLNPRNPLIRVLNKINTWEEKVLLDKGLGLEASGALFHFFVKLNREFKEVHRRLVEEMFVRAMANPSREIPLFTVQEGEVLKTVGK

SEQ ID NO: 29333 - protein, 234 aa, Arabidopsis thaliana
MDTNNQQPPPSAAGIPPPPPGTTISAAGGGASYHHLLQQQQQQLQLFWTYQRQEIEQVNDFKNHQLPLARIKKIMKADEDVRMISAEAPILFAKACELFILELTIRSWLHAEENKRRTLQKNDIAAAITRTDIFDFLVDIVPRDEIKDEAAVLGGGMVVAPTASGVPYYYPPMGQPAGPGGMMIGRPAMDPNGVYVQPPSQAWQSVWQTSTGTGDDVSYGSGGSSGQGNLDGQG

SEQ ID NO: 29334 - protein, 443 aa, Salmonella enterica
IGVVGMAVMGRNLALNIESRGYTVSVFNRSREKTEEVIAENPGKKLVPYYTVKEFVESLETPRRILLMVKAGAGTDAAIDSLKPYLEKGDIIIDGGNTFFQDTIRRNRELSAEGFNFIGTGVSGGEEGALKGPSIMPGGQKDAYELVAPILTKIAAVAEDGEPCVTYIGADGAGHYVKMVHNGIEYGDMQLIAEAYSLLKGGLNLSNEELASTFTEWNNGELSSYLIDITKDIFTKKDEDGNYLVDVILDEAANKGTGKWTSQSALDLGEPLSLITESVFARYISSLKAQRVAASKVLSGPKKQPTGDKAEFIEKVRRALYLGKIVSYAQGFSQLRAASDEYHWDLNYGEIAKIFRAGCINRAQFLQKITDAYAENAGIANLLLAPYFKKIADEYQQALRDVVAYAVQNGIPVPTFSAAVAYYDSYRAAVLPANLIQAQRDYF

SEQ ID NO: 29335 - protein, 443 aa, Salmonella enterica
IGVVGMAVMGRNLALNIESRSYTVSVFNRSREKTEEVIAENPGKKLVPYYTVKEFVESLETPRRILLMVKAGAGTDAAIDSLKPYLEKGDIIIDGGNTFFQDTIRRNRELSAEGFNFIGTGVSGGEEGALKGPSIMPGGQKDAYELVAPILTKIAAVAEDGEPCVTYIGADGAGHYVKMVHNGIEYGDMQLIAEAYSLLRGGLNLSNEELASTFTEWNNGELSSYLIDITKDIFTKKDEDGNYLVDVILDEAANKGTGKWTSQSALDLGEPLSLITESVFARYISSLKAKRFAASKVLSGPKAQPVGDKAEFIGKVRPALYLGKTVSYAQGFSKLRAPSDEYHWDLNYGEIAKIFRAGCIIRAQFLQKITDAYAENAGIANLLLAPYFKKIADEYQQALRDVVTYAVQNGIPVPTFSAAVAYYDSYRAAVLPANLIQAQRDYF

SEQ ID NO: 29336 - protein, 473 aa, Unknown
  Sulfitobacter sp. EE-36
MSDKSPILLWYRRDLRLSDHPALSAAANAGRPVIPVFIKDKSVNALGAAPKWRLGLGVGALADSLEGVSSRLILREGDALEALQALIKETGAGTVYWSRLYDPDSVQRDSKIKETLCNDGIEAKSFGGHVMFEPWTVETKAGDCYKVYTPFWNNVKTRDVEPPLSAPSDLPAPESWPDSDALDGWGLGAAMDRGADVVRRFVCLGEKAAQSRLGAFMAHGVADYKLTRDIPGTDGTSNLSENLSLGEISPHQCWHAAQRALHDGKQGAETFLKELVWREFAYHLMHHTPRMLTDNWREEWDAFPWNEDERRAEVKAWKQGRTGEPFVDAAMRELYVTGRMHNRGRMIVASYLTKHLMCHWRIGQKWFEHCLIDWDPASNAMGWQWAAGSGPDASPYFRVFNPETQLDKFDKNRDYASRWIAEGRANPHKDALAFFDAIPRSWPLSADDDYPEKIIALDEGRERALETYKGRNF

SEQ ID NO: 29337 - protein, 112 aa, Unknown
  uncultured archaeon GZfos23H7
MKKIEAIIRPEKLDEVKNALEKEKLVSMNVTEIRGRGRQKGAKLMWRGDEYLMEMVPKMKIDMVVRDEDAEKVVKIIRETAYTGNIGDGKIFVLPVEEAIRVRTGERGEEAL

SEQ ID NO: 29338 - protein, 443 aa, Salmonella enterica
IGVVGMAVMGRNLALNIESRGYTVSVFNRSREKTEEVIAENPGKKLVPYYTVKEFVESLETPRRILLMVKAGAGTDAAIDSLKPYLEKGDIIIDGGNTFFQDTIRRNRELSAEGFNFIGTGVSGGEEGALKGPSIMPGGQKDAYELVAPILTKIAAVAEDGEPCVTYIGADGAGHYVKMVHNGIEYGDMQLIAEAYSLLKGGLNLSNEELANTFTEWNNGELSSYLIDITKDIFTKKDEDGNYLVDVILDEAANKGTGKWTSQSALDLGEPLSLITESVFARYISSLKGKRVAASKVLSGPKAQPAGDKAEFIEKVRRALYLGKIVSYAQGFSQLRAASDEYHWDLNYGEIAKIFRAGCIIRGEFLQKITDAYAENAGIANLLLAPYFKKIADEYQQALRDVVAYAVQNGIPVPTFSAAVAYYDSYRAAVLPANLIQAQRDYF

SEQ ID NO: 29339 - protein, 385 aa, Nocardia farcinica
MSQREWIEKDYYKELGVSSTASQDEIKKAYRKLARDLHPDANPGDSKAEERFKAVSEAHAVLSDPAKRKEYDETRRLFAGGGYPRGGFGPGGAGGFSQGFDIGDIFGGTAAGDGGLGDILGGLFNRGGTRTTSRPRRGADVETETTLGFREAAQGVTVPLRMTSPSPCTTCHGSGAKPGTSPRVCPICNGTGVVSRNQGAFGFSEPCDGCRGTGSIIDDPCVDCHGSGIQNRTRTITVRIPPGVSDGQRIRLAGQGEAGLRGAPSGDLYVTVHVSQDKVFGRNGDDLTLVLPVSYAELVLGTTVSVPTLDGRVGVKVPPGTADGRTLRVRGRGVPKRGGGAGDLLVTVKVAVPQKLDDDALEALERYREAEKASGFDPRAGWAGA

SEQ ID NO: 29340 - protein, 421 aa, Unknown
  Bradyrhizobium sp. BTAi1
MAPAARTEPLSRHALAFVLAGGRGSRLLELTDRRAKPAVYFGGKSRIIDFALSNAVNSGIRRIAVATQYKAHSLIRHLQMGWNFFRPERNESFDILPASQRVSETMWYVGTADAVYQNIDILETYNTKYIVVLAGDHIYKMDYELMLQQHVDQRADVTVGCLEMPREESSGFGVMHINEDDTIRDFIEKPADPPPMPGKPDKSLASMGIYVFDAKFLFEELKRDAGDPNSNHDFGRDIIPYIVKNGRAVAHQFSRSCVRAGHDQTSYWRDVGTVDAYWAANLDLTDVVPELDLYDRSWPLWTYSEITPPAKFVHDTDGRRGEATCSLVSGGCIVSGAQVQRSLLFTGSHLHSYAKVHNAVLLPYVNVARHARLTNVVVDRGVQIPEGLVVGEDPEFDAKRFRTTENGVTLITQPMIDGLNS

SEQ ID NO: 29341 - protein, 268 aa, Coprinopsis cinerea
MKIDIHKTANYKGYTALLAENTDVTGNGDLHEGFDIGWEAKDLASGGAVTEDRCGEAGNGAGGAMQGGNVWPEGLPGFKEAVLEYYHAAFALGQALFPLFALALELPERWFDDKTTNPAAIMRLLHYPPQDPTKLNEKEIGIGAHTDYECFTILWQDPCGGLQVQNTSGKWVDAVPIPGTVVVNLGDQFARWTNDVFKSTPHRVINRSGRERYSIPLFFGTDYNVLLEPIETCVYPDSPPHYEVMTAGDYVKSRLDATYAHSAPASNI

SEQ ID NO: 29342 - protein, 443 aa, Salmonella enterica
IGVVGMAVMGRNLALNIESRGYTVSVFNRSREKTEEVIAENPGKKLVPYYTVKEFVESLETPRRILLMVKAGAGTDAAIDSLKPYLEKGDIIIDGGNTFFQDTIRRNRELSAEGFNFIGTGVSGGEEGALKGPSIMPGGQKDAYELVAPILTKIAAVAEDGEPCVTYIGADGVGHYVKMVHNGIEYGDMQLIAEAYSLLKGGLNLSNEELASTFTEWNNGELSSYLIDITKDIFTKKDEDGNYLVDVILDEAANKGTGKWTSQSALDLGEPLSLITESVFARYISSLKAKRVAASKVLSGPKAQPAGDKAEFIGKVRRALYLGKIVSYAQGFSQLPAASDEYHWDLNYGEIAKIFRAGCINRGEFLQKITDAYAENAGIANLLLAPYFKKIADEYQQALRDVVAYAVQNGIPVPTFSAAVAYYDSYRAAVLPANLIQAQRDYF

SEQ ID NO: 29343 - protein, 232 aa, Unknown
  Rosa hybrid cultivar
EWGVMHLVNHGISDELMERVKKAGQAFFDLPIEQKEKYANDQASGKIQGYGSKLANNASGQLEWEDYFFHCVYPEDKRDLSIWPQTPSDYIVATSEYAKELRGLATKILTVLSLGLGLEEGRLEKEVGGLEELVLQMKINYYPKCPQPELALGVEAHTDISALTFILHNMVPGLQLFYGGKWVTAKCVPNSIVMHIGDTLEILSNGKYKSILHRGLVNKEKVRISWAVFCEP

SEQ ID NO: 29344 - protein, 443 aa, Salmonella enterica
IGVVGMAVMGRNLALNIESRGYTVSVFNRSREKTEEVIAENPGKKLVPYYTVKEFVESLETPRRILLMVKAGAGTDAAIDSLKPYLEKGDIIIDGGNTFFQDTIRRNRELSAEGFNFIGTGVSGGEEGALKGPSIMPGGQKDAYELVAPILTKIAAVAEDGEPCVTYIGPDGAGHYVKMVHNGIAYGDMQLIAEAYSLLKGGLNLSNEELASTFTEWNNGELSSYLIDITKDIFTKKDEDGNYLVDVILDEAANKGTGKWTSQSALDLGEPLSLITESVFARYISSLKAQRVPASKVLSGPKAQPAGDKAEFIGKVRRALYLGKTVSYAQGFSQLPAASDEYHWDLNYGEIAKIFRAGCIIRAQFLQKITDAYAENAGIANLLLAPYFKKIADEYQQALRDVVAYAVQNGIPVPTFSAAVAYYDSYRAAVLPANLIQAQRDYF

SEQ ID NO: 29345 - protein, 228 aa, Oryza sativa
MAAAAARSGAHPPSFASSLGRCRVLPVVVVRRPGGAARPSPLLAPARCAAAVGTAAPKVEGGGRRSSEQGQLAVAPARLVDELVEEALVWSSQHGLVVGDKNHPRSGKAPGVGLLHAPFALLPMSFSKVYWDQAVELAPLFNELVDRVSLDGDFLQETLARTKEVDSFTGRLLDIHAKMMKLNKKEDVTLGLTTSDYMVDGATDQLLQVELNTISTSSNGLACGVCEL

SEQ ID NO: 29346 - protein, 507 aa, Novosphingobium aromaticivorans
MTVAEAETYWTALAGLPRPTLKELFSDAGRLDRYAATLDLPGGPIRFDWSKTHLSAEVEAVFAALASAMDFEGRRAALIEGAKINNTEGRAAEHTAQRGIGNEASVEEAEALHARMRMLVDAIHAGALGEVRSLIHIGIGGSALGPALAIDALTRDGAKVAVHVVSNIDGCALEAAMKACDPATTMIAVASKTFTTTETMTNAASALEWLRENGVADPYGQVVALTAAPEKAVEWGVDETRVLPFSETVGGRYSLWSSIGFPVAMALGWEGFAAFLDGAAAIDRHFIDADLAGNVVVRAAFADLYYTQVRGCQTRAVFAYDERLALLPDYLQQLEMESNGKRVLADGSPLTRPSAPVTWGGVGTDAQHAVFQLLHQGTHLIPVDFLAVKTQGHDLDPAHHQILLSNCFAQGAALMAGKASDDGARAYPGDRPSATILCDDLNPATLGALIAFHEHRTFVSAVMLGINPFDQFGVELGKAIAKQIESGGGEGFDPSTEALLAAVGLAG

SEQ ID NO: 29347 - protein, 349 aa, Arabidopsis thaliana
MAAIASTLSLSSTKPQRLFDSSFHGSAISAAPISIGLKPRSFSVRATTAGYDLNAFTFDPIKESIVSREMTRRYMTDMITYAETDVVVVGAGSAGLSAAYEISKNPNVQVAIIEQSVSPGGGAWLGGQLFSAMIVRKPAHLFLDEIGVAYDEQDTYVVVKHAALFTSTIMSKLLARPNVKLFNAVAAEDLIVKGNRVGGVVTNWALVAQNHHTQSCMDPNVMEAKIVVSSCGHDGPFGATGVKRLKSIGMIDHVPGMKALDMNTAEDAIVRLTREVVPGMIVTGMEVAEIDGAPRMGPTFGAMMISGQKAGQLALKALGLPNAIDGTLVGNLSPELVLAAADSAETVDA

SEQ ID NO: 29348 - protein, 161 aa, Unknown
  Acidovorax sp. JS42
MTTAYDFDATCIDGAPQPLSDFRGQVLLIVNTASACGFTPQFTGLQALHERYGPRGLAVLGFPCNQFGHQDPGSNDAIAGFCQRNYGVQFPMMSKIDVNGSDAHPLYRWLTGEAPGVLGTKAIKWNFTKFLVGRDGQVIRRYAPQEAPEKLTVDIEAALAA

SEQ ID NO: 29349 - protein, 193 aa, Exiguobacterium sibiricum
MRRGTSERVSSESEIKVAVDLSGGPVEIKTGVGFFDHMLTLFAFQARIGLVIEAKGDLWIDAHHTVEDTAIVLGAALTEALGDKAGIERYGESRVPMDETLASVVLDFSGRPYTVFLAEFKNPKLGDFDTELAEEFFQGLSRSARMTIHAQVLYGSNTHHMIEGLFKALGRAVRQAVAVTGDGVPSTKGLIDQ

SEQ ID NO: 29350 - protein, 307 aa, Oceanobacillus iheyensis
MRVVNDVTELIGQTPMVKLNRLQPENAADIYVKLEMFNPSGSVKDRAASHMIRVAEEQGLIKQGATIIEPTSGNTGIGLAMAASAKGYKAIMIMPDNSTMERRNILKAYGAEVVLTPSEEKMPGSIRKALELQKSIPNSFIPQQFENVANPDVHRISTALEILEQMDNQLDAFVCTAGTGGTVTGTGETLKEKLPHVHVAVVEPEGSPVLSGGKPGPHKLVGTSPGFVPDILNTDVYDEIIQIKDEQAVTLLKDLAQKEGIFLGPSGAAAVYAAMEVAKKLGPNKKLVCIAPDTGERYLSMDMFDEK

SEQ ID NO: 29351 - protein, 150 aa, Brassica napus
MTHTDEMVSIELPAPSSWKKLFYPELAGSPRKTKIVFVAPTGERISSRKQLEKYLKAHPGSPVISELDWTNGESPRRSSRISQMVKATPTPTPDEKEPPKKRRRSSLSKKGGKGAASAEKNEEAQEGEVVAEENVEADKNGEAEESAGKE

SEQ ID NO: 29352 - protein, 473 aa, Bacillus thuringiensis
MMDQNKGLKRELKSRHIFMIALGGVIGTGLFLGSGYTIHEAGPGGAIVAYLVGGFVMYLTMLCLGELAVAMPDAGSYQTYATKHISPAAGYVVGWMSWLNWSATIGIELIAVSILMKRWFPDVPSWIWCVVFAVLLFAINALSSRSFAEVEFWFASIKVITIIAFIILGGAAMFGFLDMKGNEPAPMFSSFIDYGGLFPNGLSAILITMIAVNFSFQGTELVGIAAGESENPEKTIPKAINNTVWRILVFFVLSIFILAGLFPWQQAGVIESPFVVVFDKIGIPYAADIINFVIITAVLSVANSGLYATSRMLWSMSNQGMISPIFGKLSKNGVPIYALIVSTIVGCLSLLSGIYAEDTVYLWLLSIAGFGAILVWASIALSNLLARRSYIKQGGDVKDLKFKTPLYPFVPLLALVLNVTVIVGMAFIPEQRMALYCGIPFMIVCLLFYRATRNKAHKVEHIEKTNTTEVESL

SEQ ID NO: 29353 - protein, 313 aa, Vibrio fischeri
MRYFPMFMDIKKRPVLVVGGGEVACRKIDMLLQAEASITVVAPSIKAYLMKYVEEGKLEYIKGFYHKNLLSNDYVQVWATTDNSDLNHQVHADAHDVGVPVNVVDDTEYCDFITPSMVNRGRVQVAISSGGASPVLIRIIREQLETQLSTKVAMLADFGADKRNLIKQHFKTVDERRKFWETFLRLPEIEKINTRNELEALFQQALTTDVQIKSERNWIEYNSDTEMLTLKALRLMQQAEWVIAFESCPAEFIELCRRDAERIYIRSEKEMADYLDKANAENIRVTILVKKGQLFSDSNIQHYLANDVYVPTL

SEQ ID NO: 29354 - protein, 431 aa, Geobacillus kaustophilus
MKTTTIAEVNQYVGQQVTIGAWLANKRSSGKIVFLQLRDGTGFIQGVVEKANVSEEVFQRAKTLTQETSLYVTGTVRIDERSPFGYELSVADLQVIQEAVDYPITPKEHGVEFLMDHRHLWLRSRRQHAIMKIRNEIIRATYEFFNDRGFVKVDAPILTGSAPEGTTELFHTKYFDEDAYLSQSGQLYMEAAAMALGKVFSFGPTFRAEKSKTRRHLIEFWMVEPEMAFYEFEDNLRLQEEYVSYLVQSVLERCRLELGRLGRDVSKLELVKPPFPRLTYDEAIKLLHEKGLTDIEWGDDFGAPHETAIAESFDKPVFITHYPTSLKPFYMQPDPNRPDVVLCADLIAPEGYGEIIGGSERIHDYELLKRRLEEHHLPLEAYEWYLDLRKYGSVPHSGFGLGLERTVAWICGVEHVRETIPFPRLLNRLYP

SEQ ID NO: 29355 - protein, 718 aa, Geobacillus kaustophilus
MLHISRTFAAYLDEMDQIVVLAPKSLGFDGMAPFTLVAPSGEEIPLSVQHVEDVGETVKYVCRFASAFEFGATYWVRSCRGEETDVQIGAVVRTPAFDDRFFYDGPLGAEYLKEQTVFRVWAPTATAVSVKLVHPHLDEIRCVPLVRGERGVWSAVVPGDWERARYTYIACINRVWREAVDPYATAVSVNGEFGVVIDWEKTKLAPPSLPLPPLCSPTDAIIYELSIRDFTSHPDSGAVHKGKYLGLAETNTSGPNGTATGLSYVKELGVTHVQLMPFMDFAGVDERDPQAAYNWGYNPLHLYAPEGSYATDPADPYARIVELKQAIHTLHENGLRVVMDAVYNHVYDREQSPLEKLVPGYYFRYDAYGQPANGTGVGNDIASERRMARRWIVDSVVFWAKEYGIDGFRFDLMGVHDIETMKAVRDALDAIDPSILVYGEGWDLPTPLPPEQKATMANAKQLPRFAYFNDRFRDAVKGSTFHLPDRGFALGNPGGREQVKLAIAGSLRALGGLFCHPRQSINYVECHDNHTFWDKMEAANHDEPEWLRRKRQKLATAIVLLAQGIPFLHSGQEFYRTKGGDGNSYRSPDAVNQLDWERKSRYEDDVRYVQGLIALRRAHGAFRLATEAEVLRHFTFLEPLPPSVIAYRLHDAAVYGPWEDIIVVHHNEEKETAIALPDEREWAVVCDGQRCGTTPFGQARGMLRLDGIGTWVLVHPAG

SEQ ID NO: 29356 - protein, 305 aa, Triticum aestivum
  misc_feature (84)..(84): Xaa can be any naturally occurring amino acid
  misc_feature (95)..(95): Xaa can be any naturally occurring amino acid
MPPLLTSPASLSSSPLRLASRLGGAALRPTSHHHRRFLAPAPQTAPRGTTTGGGFAAMSWLGKLGLGGGGSPRASEASAALGAXGPDEDKPAPGXEFAQFGAGCFWGVELVFQRVPGVTRTEVGYSQGAFHDPTYEDVCTGATGHNEVVRVQYDPAACKYDDLLDTFWARHDPTTPNRQGGDVGTQYRSGIYYYTSEQEKAALESMEKQQKVQNRKIVTEILPAKRFYRAEEYHQQYLAKGGRFGFKQSTEKGCNDPIRCYGMSEPGDLTSMEAHKQQFYSQECCLNNGGCQLNFTTVFLACAVT

SEQ ID NO: 29357 - protein, 375 aa, Arabidopsis thaliana
MNEEEAPSEQKKTLSLVPSPTTNLFLPDDILLSSLSRISRLYYPTFSLVSKSFRSLIASPELYQTRSILGRTESCLYVSLRLLNDSNLRWYTLCRVPDRKLTNFSGGHLLVPILSRYAPPAHWSSVVAVDYNIYAIGGPINDAPSSSVSVLDCQCEKWREAPSMRVARNYPTATVLDGKIYVAGGCEDCTSLDCIEVFDPKTQTWDSVASPGTERCERLVYKSVGIEGKYHLFGGAGHVAYDPKEGRWDSVGMDMEMGRTWVSYCVINNILFYYNDREFKWYDYKGRFWRKLMGLERLIKFLCYSRVNLAAYGEKMAVLWDTFVPSSSKNKMIWCAEITIERHDIYEICGKTEWFDVVLRVPKSYELVHVLAATV

SEQ ID NO: 29358 - protein, 384 aa, Robiginitalea biformata
MMRILEEDREALLEANKKDLDAFDRDDQALYDRLVMDSAKIDGMIRSVGEVLEQDDPVNREISRRTVSDGLEVINRTAPFGTILIIYESRPDVTVEAAVLAFKSNNKILLKGGKEAYHSNVALVACWHKALEENDLSADWIRMLKLDRLATREFLMNPPEPIDLIVPRGGERLIAFVKEHATCAVLVSGRGNNFLYVAEDADWDQSLKVILNAKTDKISACNALDKILISSKLPDYEDKLRQLRKVLKAHSVSILVSDRVGTILPEEEVIQDDSIWYEEFLALKCSIGLVDSTEDAIAAINKYSGGHSASIMTRDDEKAEAFMQQVDSAAVYRNASTRFTDGGQMGVGAELAISTDKLHHRGPLGLNELVTNKYYVYGDGHVRV

SEQ ID NO: 29359 - protein, 681 aa, Nicotiana sylvestris
MSGSGCSIVWFRRDLRVEDNPALAAGVRAGAVIAVFIWAPEEEGHYYPGRVSRWWLKQSLAHLDSSLKSLGTSLVTKRSTDSISSLLEIVKSTGATQLFFNHLYDPISLVRDHRAKEVLTAQGISVRSFNADLLYEPWEVNDEEGRPFTTFSAFWEKCLSMPYDPEAPLLPPKRIIPGDASRCSSDSLVFEDESEKGSNALLARAWSPGWSNADKALTTFVNGPLLEYSQNRRKADSATTSFLSPHLHFGEVSVRKVFHFVRIKQVLWANEGNKAGEESVNLFLKSIGLREYSRYMSFNHPYSHERPLLGHLRYFPWVVDEGYFKAWRQGRTGYPLVDAGMRELWATGWLHDRIRVVVSSFFVKVLQLPWRWGMKYFWDTLLDADLESDALGWQYISGTLPDGREFDRIDNPQFVGYKCDPHGEYVRRWLPELSRLPTEWIHHPWNAPESVLEAAGIELGSNYPLPIVEIDSAKVRLEQALSQMWQHEAASRAAVENGMEEGHGDSADSPIAFPQAMHMEMDHEPVRNNNPVIVTVRRYEDQMVPSMTSSLFRVDDEETSVNIRNSVVDTRAEVPNDVNVTEGPRRDTLDQAVTQPARTNTTPPQFNFVVGRRNSEDSTAESSSSTRERDGGVVPVWSPSSTNYSDQYVGDDNGIGTSSSYLQRHPQSHQLMNWQRLSQTG

SEQ ID NO: 29360 - protein, 72 aa, Pseudomonas syringae
MSKEDSFEMEGTVADTLPNTMFRVELENGHVVTAHISGKMRKNYIRILTGDKVRVELTPYDLSKGRITYRAR

SEQ ID NO: 29361 - protein, 108 aa, Arabidopsis thaliana
MASGSLKSLISSAVGRGVTEARARIFGHMLNPTGQRSPHKILRKKLIGDKVAEWYPYDIKNEDPNVLAREEKDSIAIWGRISKLEMLKRRDKGPPKKGHGKRAAKRNK

SEQ ID NO: 29362 - protein, 479 aa, Oryza sativa
  misc_feature (352)..(352): Xaa can be any naturally occurring amino acid
MAERIAASLLPAASPSPAPSPPPPRPRVSAAAAASFPCCSTSAGGLRLRSRPSRFPQKAATTRSGRAGAGARAVVRCMAAAAVAASDAAQLKSAREDIREILKTTYCHPIMVRLGWHDSGTYDKNIEEWPQRGGADGSLRFDAELSHGANAGLINALKLIQPIKDKYPGITYADLFQLASATAIEEAGGPKIPMKYGRVDVTAAEQCPPEGRLPDAGPRVPADHLREVFYRMGLDDKEIVALSGAHTLGRSRPDRSGWGKPETKYTKDGPGEPGGQSWTVEWLKFDNSYFKDIKEQRDQDLLVLPTDAALFEDPSFKVYAEKYAEDQEAFFKDYAEAHAKLSDLGAKFDPPXEGFSLDDEPAVEEKDPEPAPAPAAAAPPPPVEEKKEAEPTPVPVTVGAAVASSPADDNNGAAPQPEPFVAAKYSYGKKELSDSMKQKIRAEYEGFGGSPDKPLQSNYFLNIMLLIGGLAFLTSLLGS

SEQ ID NO: 29363 - protein, 261 aa, Physcomitrella patens
MVEKVVVSSLRRKRGGNLLAPLKRNVSSIAKKSSTPKSGKPVGSPKVYKGVRMRTWGKWVSEIREPNKRSRIWLGSFPTAEMAAKAYDAAAVCLRGRSVKLNFPDSPPRCAARCNSPREVQAAATAAAVACIPSATALTVANFQSPAQTLESSPLHSSPSSSDMSSGDEDSGEDSVQSFVAEGSQISPSEVVPVLEWVKVEFGDKETVAAGDVDFDCDYSFISEFAADSLLACSYNSKGRTEYLPIETHDAALYDSTLWFF

SEQ ID NO: 29364 - protein, 313 aa, Chamaebatiaria millefolium
GGLGDVLGGLPPAMAANGHRVITISPRYDQYKDAWDTEVSIEVKVGDKTETVRFFHCYKRGVDRVFVDHPLFLEKVWGKAASKIYGPITGEDYKDNQLRFSLLCQAALEAPRVLNLNSSKYFSGPYGEEVVFIANDWHTALLPCYLKAIYKPEGIYNTAKVAFCIHNIAYQGRFAFADFSLLNLPDEFKSSFDFIDGYDKPVKGRKINWMKAGILESDKVLTVSPYYAKELVSSVDKGVELDKFIRKVGIRGIVNGMDVQEWNPLTDKYTNVKYDATTVTDAKPLLKEALQAEVGLPVDRNIPVIGFIGRLEE

SEQ ID NO: 29365 - protein, 169 aa, Zea mays
MAPTVMMASSATAVAPFQGLKSTASLPVARRSSRSLGNVSNGGRIRCMQVWPAYGNKKFETLSYLPPLSTDDLLKQVDYLRNGWIPCLEFSKVGFVYRENSTSPCYYDGRYWTMWKLPMFGCNDATQVYKELQEAIKSYPDAFHRVIGFDNIKQTQCVSFIAYKPPGSD

SEQ ID NO: 29366 - protein, 1118 aa, Hordeum vulgare
MDCLRLAVAAAALLLAALAAAADDAQLLDEFRMALPSQAPLEGWTAREGACRFPGAVCRGGRLTSLSLAAVTLNADFRAVANTLLQLSAVERLSLRGANVSGALAAARCGGKLEELDLSGNAALRGSVADVAALAGSCGALRTLNLSGDAVGAAKPAGGGGGGQGFAALDALDLSSNKIAGDADLRWMVGAGLGSVRWLDLAWNKISGGLSDFTNCSGLQYLDLSGNLIAGDVAAAALSGCRSLRALNLSSNHLAGAFPPNIAGLTSLTALNLSNNNFSGEVPADAFTGLQQLQSLSLSFNHFSGSIPDSVAALPDLEVLDLSSNNFSGSIPDSLCQDPNSRLRVLYLQNNYLSGSIPEAVSNCTDLVSLDLSLNYINGSIPESLGELSRLQDLIMWQNLLEGEIPASLSSIPGLEHLILDYNGLTGSIPPELAKCKQLNWISLASNRLSGPIPSWLGKLSNLAILKLSNNSFTGKIPAELGDCKSLVWLDLNSNQLNGSIPPELAEQSGKMTVGLIIGRPYVYLRNDELSSQCRGKGSLLEFSSIRSEDLSRMPSKKLCNFTRMYMGSTEYTFNKNGSMIFLDLSFNQLDSEIPKELGNMFYLMIMNLGHNLLSGAIPTELAGAKKLAVLDLSHNRLEGQIPSSFSSLSLSEINLSSNQLNGTIPELGSLATFPKSQYENNSGLCGFPLPPCESHTGQGSSNGGQSNRRKASLAGSVAMGLLFSLFCIFGLVIIAIESKKRRQKNDEASTSRDIYIDSRSHSGTMNSNWRLSGTNALSINLAAFEKPLQKLTLGDLVEATNGFHNDSLIGSGGFGDVYKAQLKDGRVVAIKKLIHVSGQGDREFTAEMETIGKIKHRNLVPLLGYCKIGEERLLMYDFMKYGSLEDVLHDRKKIGVRLNWAARRKIAIGAARGLAFLHHNCIPHIIHRDMKSSNVLVDENLEARVSDFGMARMMSVVDTHLSVSTLAGTPGYVPPEYYQSFRCTTKGDVYSYGVVLLELLTGKPPTDSTDFGEDHNLVGWVKMHTKLKITDVFDPELLKDDPTLELELLEHLKIACACLDDRPSRRPTMLKVMTMFKEIQAGSTVDSKTSSVATGLSDDPGFGVMDMTLKEAKEEKD

SEQ ID NO: 29367 - protein, 313 aa, Kerria japonica
GGLGDVLGGLPPAMAANGHRVMTVSPRYDQYKDAWDTEVTVELKVGEKTETVRFFHCYKRGVDRVFVDHPLFLEKVWGKTASKLYGPITGEDYKDNQLRFSLLCQAALEAPRVLNLNSSKYFSGPYGEEVVFIANDWHTALVPCYLKAIYRPKGIYKSAKVAFCIHNIAYQGRFAFADFALLNLPDEFKSSFDFIDGYDKPVKGRKINWMKAGILESDKVLTVSPYYAEELVSAVEKGVELDNIIRKVGILGIVNGMDVQEWNPLTDKYTTVKYDSSTVTDAKPLLKEALQAEVGLPVDRNIPVIGFIGRLEE

SEQ ID NO: 29368 - protein, 162 aa, Leifsonia xyli
MSLMDIPFRTIDGEPTSLAAFAGKVILVVNVASRCGLAPQYEKLEGLQKTYGDRGFTVIGFPSNQFLQELNSTDAIKEYCSTTWGVTFPMMEKVKLNGRSAHPLYAELTTYPDAAGKAGKVKWNFEKFMITPGGAVHRFRPTTEPDAPEIIGLIEQALPTAV

SEQ ID NO: 29369 - protein, 313 aa, Purshia tridentata
  misc_feature (33)..(33): Xaa can be any naturally occurring amino acid
  misc_feature (38)..(38): Xaa can be any naturally occurring amino acid
GGLGDVLGGLPPAMAANGHRVMTVSPRYDQYRXAWDTXVLVELEVGGRTETVRFFHCYKRGVDRVFLDHPWFLEKVWGKTGSKIYGPRAGEDYKENQLRFSLLCKAALEAPKVLNLNSNQYFSGPYGEDVIFIANDWHTALLPSYLKSFYKPRGIYKNAKVAFCIHNIAYQGRFPFADFSCLDLPDQLRSSFDFIDGYNKPVKGRKINWMKAGILESDRVITVSPYYAQELVSGEDKGVELDNIIRKTGITGIVNGMDVQEWNPATDKYLDVKYDATTVLDAKPLLKEALQAQAGLPVHQNIPVIGFIGRLEE

SEQ ID NO: 29370 - protein, 561 aa, Geobacter metallireducens
MKLRVVVIGANAAGAKAASKAKRMNPHAEVTLIERGNFISYGACGIPYFVSDTVADVKELMSTPVGVVRDAAFFNKVKGVHVITGTEVVSLDRQSRTVQLFEKESAKAFSLEYDRLVLATGSSPSLPPLKNRDLGNILTVKAIEDAELLKERAVTGKRACIVGGGLIGLETAEALRQKGLEVTIVEMRDQLLPGILDPEMASLVERHIRQNGVEVETSCRVAGFDGTGVVNKVLTERGEIPADVVVLAPGVTPNVKLAKEAGLEIGPTGAIAVDSRMGTSDPAIYACGDCCETTHLVTGKKVHVPLGSTANKQGRVAGINASGGEATFAGILGTSILRVFSVNAGKTGLTESEARAQGYDVETVLSPAPDKAHFFPGAKPIALKLVADRATGRILGLQAVGEGAVDKRVDAAAAAITFGATADQLSHLDLAYAPPYSAAMDNLIVAADILKNKLAGHARGISPRKVRQMLDDGDDFILLDVRSPAEHAEVGIEGATLIPLGALREKLESLPKDKEIVTFCKISLRGYEAQKILDAAGFRDVKFLDGGIMTWPYELRRGGGA

SEQ ID NO: 29371 - protein, 216 aa, Xanthomonas campestris
MLGIGAFKQRMPRSGEALPGRTQALPLHNTHLINGHPLRGEFTGLAQVQFGLGCFWGAERKFWNVPGVYTTAVGYAGGKTPNATYSEVCSGQTGHTEAVLVVYDAQAVSFEQLLRTFWESHDPTQGMQQGNDVGTQYRSAIYCSTQAQYDAAIASRDAYQQQLTAAGYGDITTEILYPAPTFYYAEDDHQQYLAKHPNGYCGLGGTGVSCPIGLDA

SEQ ID NO: 29372 - protein, 313 aa, Rhodotypos scandens
GGLGDVLGGLPPAMAANGHRVMTISPRYDQYKDAWDTEVTVELKVGEKTETVRFFHCYKRGVDRVFVDHPLFLEKVWGKTASKIYGPQVGDDYKDNQLRFSLLCQAALEAPRVLNLNSSKYFSGPYGEEVVFVANDWHTALLPCYLKAIYKPKGIYKSAKVAFCIHNIAYQGRFAFADFALLNLPDQFLSSFHFIHGYGKPVKGRKINWMKAGILESDKVLTVCPYYAEELVSTVQKGVELDNIIRKVGIRGIVNGMDVQEWNPLTHKYTTVKYHASTVTHAKPLLKEALQAEVGLPVDSDIPVIGFIGRLEE

SEQ ID NO: 29373 - protein, 115 aa, Gluconobacter oxydans
MPFVKLVTAIIKPFKLDDVREALTPLGVQGLTVTEVKGFGRQKGQTEIYRGAEYHVSFLPKLKIEVAVSDTIAEDVIEAIMTAARTGKIGDGKIMVSSLDQLIRIRTGETGEGAL

SEQ ID NO: 29374 - protein, 313 aa, Sorbaria sorbifolia
GGLGDVLGGLPPAMAANGHRVITVSPRYDQYKDAWDTSVLVELEVNGRTESVRFFHCHKRGVDRVFVDHPVFLERVWGKTGSKIYGPRAGEDYKDNQLRFILLCQAAPEAPRVLNLNSNEYFSGPYGEDVVFIANDWHSALLPCYLKTIYKPKGIYKSAKVAFCIHNIAYQGRFPFSDFSLLDLPDQLKGSFDFLDGYNKPVKGRKINWMKAGILESDKVVTVSPYYAQELVSGEDKGVELDNIIRTTGISGIVNGMDVQEWNPATDKYLDIKYDNTTVLDAKPLLKEALQAEVGLPVDRNIPVIGFIGRLEE

SEQ ID NO: 29375 - protein, 413 aa, Lactococcus lactis [sequence omitted]

SEQ ID NO: 29376 - protein, 270 aa, Lactococcus lactis
MIMTRKNILSVKRIVVKIGTSSLILPNGKINLSNIDELAFVLSDLNNKGYEVILVTSGAIGVGLNVLGIDKRPKGIADQQALASIGQVELMSLYTQMFRRYSQKVSQLLLTRDVTDFPTSRENAENALNALLGLGIIPIINENDAIAVDEMDHQTKFGDNDKLGAIVSKLVNADLLIMLSDIDGLFDKNPSIYDDAKIFNEIHEITDELRQMAGGAGSRFGTGGMTSKLAAAQILFENGQEMVLTNGERIREIKEIIEGREIGTYFHQKS

SEQ ID NO: 29377 - protein, 529 aa, Xanthomonas campestris
MLDANLKTQLTAYLERVTRPIQIHASIDDIPKAREMLELLEDLVLLSDKISLDVHRDDNQRKPSFALTTPGQDISVRFAGLPMGHEFTSLVLALLQVGGHPSKATAELIEQVQHLDGDYQFETYFSLSCQNCPDVVQALNLAAVLNPRIKHVAIDGALFQDEVETRQIMSVPTVYLNGELFDQGRMTLEQIVAKLDTNAAKRDAAKIAAKDAFDVLVVGGGPAGSAAAVYAARKGIRTGVAAERFGGQVLDTMSIENFISVPETEGPKMAAALEQHVRQYDVDIMNLQRAEQLIPAGADGLVEIKLANGASLKSKTVILSTGARWRQMNVPGEDQYRNKGVAYCPHCDGPLFKGKRVAVIGGGNSGVEAAIDLAGIVAHVTLVEFDDKLRADEVLQRKLRSLHNVRIITSAQTTEVLGDGQKVTGLVYKDRTGGDTQHIDLEGVFVQIGLLPNTEFLRGTVELSPRGEIIVDDRGQTNVPGVFAAGDATTVPYKQIVIAMGEGSKAALSAFDYLIRSSAPVSADVAQAA

SEQ ID NO: 29378 - protein, 292 aa, Brucella melitensis
MSKADEAAACVIAKSKVALPVMEPGHVWLVGAGPGDPGLLTLHAVNALQQADVIVYDALVDDSCLSLKNATATLEYAGKRGGKPSPRQRDISLRLVELARQGKKVLRLKGGDPFVFGRGAEEALTLVEYHVPFRIVPGVTAGVGGLAYAGIAATHRDINQAVTFLTGHDATGAMPDGVDWAGIARSSPVIVMYMAMKHIGLIAGRLIEAGRSPDEPVAFVCNASLPDQTVLETTLGRAAIEVEAAGLQPPAIVVVGEVVRLRAGLDWIGAMAGKSLVSDPLGKRTQQGVQSA

SEQ ID NO: 29379 - protein, 443 aa, Salmonella enterica
IGVVGMAVMGRNLALNIESRGYTVSVFNRSREKTEEVIAENPGKKLVPYYTVKEFVESLETPRRILLMVKAGAGTDAAIDSLKPYLEKGDIIIDGGNTFFQDTIRRNRELSAEGFNFIGTGVSGGEEGALKGPSIMPGGQKDAYELVAPILTKIAAVAEVGEPCVTYIGADGAGHYVKMVHNGIEYGDMQLIAEAYSLLKGGLNLSNEELANTFTEWNNGELSSYLIDITKDIFTKKDEDGNYLVDVILDEAANKGTGKWTSQSALDLGEPLSLITESVFARYISSLKAQRVAASKVLSGPKAQPAGDKAGFIEKVRRALYLGKIVSYAQGFSQLRAASDEYHWDLNYGEIAKIFRAGCIIRAQFLQKITDAYAENAGIANLLLAPYFKKIADEYQQALRDVVAYAVQNGIPVPTFSAAVAYYDSYRAAVLPANLIQAQRDYF

SEQ ID NO: 29380 - protein, 448 aa, Clostridium perfringens
MEVKKYVDNLMEDLKKNNPGESEFLAAAEEVLYSLVPVLEKNPKYIEEGILERIVEPERVIMFRVPWVDDAGNVRVNRGYRVQFNSAIGPYKGGLRFHPSVNLSIIKFLGFEQIFKNSLTTLPIGGGKGGSNFDPKGKSDREIMRFCQSFMSELYRHIGPNTDVPAGDIGVGGREIGYMFGQYKKLKNSVDAGVLTGKGLTYGGSLARKEATGYGLVYFVDEMLRDNGQTIEGKTVVISGSGNVAIYATEKVQELGGKVVALSDSLGYVYDENGIDLEIVKEIKEVKRGRISEYVNYVKTAKFTEGFSGIWNVKCDIALPCATQNEIDKSSAKTLIDNGVIAVGEGANMPSTLEAQKLFVDNKILFAPAKAANAGGVATSALEMSQNSLRMSWTFEEVDAKLKDIMKNIYYNSKNAASEYGHNGNLIVGANIAGFKKVADAMLDHGII

SEQ ID NO: 29381 - protein, 161 aa, Unknown
  Cichorium intybus x Cichorium endivia
MGFSEKQEALVKESWEVMKQDIPALSLYLYAMILEIAPEARGLFSFLKDTNVIPQNNPKLKSHAVKVFKMVCESAIQLREKGEVVVSGSTLKYLGSVHLEKGIVDPQFEVVKEALIRTVAKAMGEKCSEEMKSAWSEAYDELADAIKTEMKKEAAETQTHI

SEQ ID NO: 29382 - protein, 443 aa, Salmonella enterica
IGVVGMAVMGRNLALNIESRGYTVSVFNRSREKTEEVIAENPGKKLVPYYTVKEFVESLETPRRILLMVKAGAGTDAAIDSLKPYLEKGDIIIDGGNTFFQDTIRRNRELSAEGFNFIGTGVSGGEEGALKGPSIMPGGQKDAYELVAPILTKIAAVAEDGEPCVTYIGADGAGHYVKMVHNGIEYGDMQLIAEAYSLLKGGLNLSNEELANTFTEWNNGELSSYLIDITKDIFTKKDEDGNYLVDVILDEAANKGTGKWTSQSALDLGEPLSLITESVFARYISSLKAQRVAASKVLSGPKAQPAADKAEFIEKVRRALYLGKIVSYAQGFSQLRAASDEYHWDLNYGEIAKIFRAGCIIRAQFLQKITDAYAENADIANLLLAPYFKKIADEYQQALRDVVAYAVQNGIPVPTFSAAVAYYDSYRAAVLPANLIQAQRDYF

SEQ ID NO: 29383 - protein, 443 aa, Salmonella enterica
IGVVGMAVMGRNLALNIESRGYTVSVFNRSREKTEEVIAENPGKKLVPYYTVKEFVESLETPRRILLMVKAGAGTDAAIDSLKPYLEKGDIIIDGGNTFFQDTIRRNRELSAEGFNFIGTGVSGGEEGALKGPSIMPGGQKDAYELVAPILTKIAAVAEDGEPCVTYIGADGAGHYVKMVHNGIEYGDMQLIAEAYSLLKGGLNLSNEELANTFTEWNNGELSSYLIDITKDIFTKKDEDGNYLVDVILDEAANKGTGKWTSQSALDLGEPLSLITESVFARYISSLKAHRVAASKVLSGPKAQPAGDKAEFIEKVRRALYLGKIVSYAQGFSQLRAASDEYHWDLNYGEIAKIFRAGCIIRAQFLQKITDTYAEKAGIANLLLAPYFKKIADEYQQALRDVVAYAVQNGNPVPTFSAAVAYYDSYRAAVLPANLNQAQRDYF

SEQ ID NO: 29384 - protein, 357 aa, Medicago sativa
MAQAKTITSLSEENTFESGFIRDEDERPKVAYNQFSNEIPVISIAGIDEVNGRREEICKKIVEACEEWGIFQIVDHGVDTKLISEMTHLSREFFALPPEEKLRFDMSGGKKGGFVVSSHLQGEVVQDWREMVIYFSYPIKDRDYSRWPDKPEEWKKVIEEYSENLMNLGCKLLEVLSEAMDLEKDALTKACVDMDQKIVVNLYPKCPKPDLTLGNKRHTDPGTITLLLQDQVGGLQATKDNGKTWITIQPIEGAFVVNLGDHGHVLSNGRFKNADHQAVVNSNHDRLSIATFQNPAQDATVYPLKIREGEKSLLEEPITFAEMYRRKMSKDIETAKLKKLAKEKQLQDMEINAKVED

SEQ ID NO: 29385 - protein, 415 aa, Oceanobacillus iheyensis [sequence omitted]

SEQ ID NO: 29386 - protein, 98 aa, Cynodon dactylon
RKKAKKSVETYKIYIFKVLKQVHPDIGISSKAMSIMNSFINDIFEKLAQEAARLARYNKKPTITSREIQTSVRLVLPGELAKHAVSEGTKAVTKFTSN

SEQ ID NO: 29387 - protein, 203 aa, Triticum aestivum
  misc_feature (163)..(163): Xaa can be any naturally occurring amino acid
  misc_feature (196)..(196): Xaa can be any naturally occurring amino acid
MAAAKENYRVELRAAARQLGDRCLYSASADAWELLVGIEPDATPSQSAAMDTPSSSGAAPGGRLLHLHRSGGSSFRRRMRSGGGAASEAGTPLGGVSYVSTPIPDDDAFDAGADKYLLAKTYFDCREYRRAAHVLRSQVGRKGRVLRCYALYMAGERRKEEEXNELEGSLGKSNVVNQELVALERELSTHRRTGAXDSFGSVL

SEQ ID NO: 29388 - protein, 454 aa, Novosphingobium aromaticivorans
MTQLPRVCIIGAGCSGFTTAKCLQDYGIPFVVYEASDDIGGNWYFNNPNGMSACYQSLHIDTSKWRLAFEDFPVPAEWPDYPHHAQLLQYFHGYVDHFDLRPHIRFNTRVEKATRRDDGGWKIRLSTGEVERFDALVVANGHYWAARIPEYPGHFDGPQIHSHAYRSPFDPIDCVGKRVLVVGMGNSAMDIASELSQRPIASRLFVSTRRGVWVLPKYYRGQPLDKNPAPAWMPKGLRNWIATRMIKKLVGRMSQYGLPEPEIGPFESHGTVSGEFLLRAGSGDIAMKPGIERLDGNAVIFSDGTREEIDAIVWATGYDIRFPFFDDPELVADADNRPPPLYKRILKPGMPDLFYVGLAQPLPTLVNFAEQQSKLVAAYLAGQYAPPPPDEMHRIIAEDEAYYTGQYYAARRHTIQLDFDHYVRALKKELAAGSKRAKASGGALPVLPRNLEPA

SEQ ID NO: 29389 - protein, 428 aa, Unknown
  Burkholderia sp. 383
MSSQLQSIPSYLHADDLGPWGNYLQQVDRVAPYLGSLSRWLETLKRPKRILIVDCPIELDNGTVAHFEGYRVQHNVSRGPGKGGVRYHQDVTLSEVMALSAWMSVKNAAVNVPYGGAKGGIRVDPRKLSRGELERVTRRYTSEIGIIIGPNTDIPAPDVNTNEQVMAWMMDTYSMNQGQTSTGVVTGKPIALGGSLGRKEATGRGVFVVGSEAAKKKGLEIEGARIAVQGFGNVGGIAAKLFQEAGAKVIAVQDHTGTIYQPAGLDSNKLLDHVARTGGVAGFEGAEPMPNDEFWTVETDILIPAALENQITEKNAGKIRTKIIVEGANGPTTTAADDILTANGVLVIPDVIANAGGVTVSYFEWVQDFSSFFWTEDEINHRLERVMREAFSGVWAVAEEHKVSVRTAAFIVACKRILMAREMRGLYP

SEQ ID NO: 29390 - protein, 648 aa, Robiginitalea biformata
MNQVAIHRLLAGKSLAKPSKKDLPALFEKRLAANLTLIQDLYYSLYPGQDAAFEELPGMLGKLFRDRSEDLRLQDLERLNEGAWYQSEKWVGMQLYTDRFSGDIRGLIDKLPYFEKLGVNFLHVMPLTRQPKGENDGGYAVSSHTEIDPRFGTEADFLEFTGACRDKGVCLMLDFVVNHTSDQYPWAQKAREGDAEYAGYYYMFPDRTLPDLYEETLPEIFPETSPGNFTFIPETGQWVMTVFNQYQWDLNYTNPRVFLAMLKNMVVLANKGVDVLRFDALAFLWKKLGTNSQNLPEAHQLIALFRLCLQVVAPGVAILAEAIVAPREIVRYFGEGRLAGNECEAAYNATYMACLWNSIATKKTNLLYRSLADIASIPESCSWINYIRCHDDIGLGFDDRQIEALGWNPAAHRRFLLDYYCQRLEWSPSRGVLFMYNPVTGDGRITGSTASLLGLEEALDSGNAADVETAFDKIVMMYGVILASAGIPLIYAGDEIGMLNDYSYLREKDKENDSRWVNRPIHDWEAVAALDDPNRLPSRIFSRLQSLIRLRRKLPSLGGGKSVLHHPGNEHLYVFERKAEKGSLLVVANFDENPQVLNATWVRNLGYLKGSAYTNLVDGTSHSVQSALLEIRPYGLLWLKTVEGAGAK

SEQ ID NO: 29391 - protein, 310 aa, Zea mays
MSAELKRDYEIREEIGRGRFGVVHRCTSRATGEAYAVKSVDRSRLGDDLDRELAQLEPKLAQLAGAGNPGVVQVHAAYEDEAWTHVVMDLCPGPDLLEWVARRRGAPVPEPVAAAIVAQVAQALALCHRRGVAHRDVKPENILIDAADDAGSDDEAEAEAAPRARLADFGSAAWVGAGGLGRAEGLVGTPHYVAPEVVAGGEYGAKADVWSAGVVMYALLSGGALPFGGDSAAEVLAAVLRGSARFPPRLFGGVSPAAQDLMRRMICRDEWRRFTVEQVLGEFFRSFPRQPLSSSCSVDLISPCSSMQFI

SEQ ID NO: 29392 - protein, 327 aa, Ehrlichia ruminantium
MKISILGAGSFGTAIAIALSAHGISVNLWGRDHRNITHINTYRKNLKYLPTYHLPDNIYATSNIDEVLSDNNTCIILTVPTQQLRTICTQIQHKQHMCKNTPMLICSKGIEITSLKFPSEIAEEILQYNPIFILSGPSFAKEIAEHLPCSIVLAGDNKELGESLIEKISNDVLKIIYHQDIIGVQIGAALKNIIAIACGIIAGKNLGNNAVATVITKGMNEIKTLYIAKNHSIDLHTLIGPSCLGDLILTCTTEHSRNMAFGLEIGKGRNINTLIDHNLKLVEGTSTVKPLISLAKKLNVELPICISIYNLLHENISLDKAISNILS

SEQ ID NO: 29393 - protein, 105 aa, Clostridium difficile
MAKVINTSEFRSSVEGSKGIVVVDFFATWCGPCNMLGPVFAELGEEMKDKARFVKVDIDESLEIAQQFNVSTVPTMIIFKDGKPVETLIGFMPKNKIEMQVKSYL

SEQ ID NO: 29394 - protein, 144 aa, Geobacillus kaustophilus
MKIALIAHDQKKEEMVAFATAYAPVLANHELYATGTTGLRIQEATGLPVHRFQSGPYGGDQEIGAMIARNEMDLVIFFRDPLTAQPHEPDISALMRLCDVYAVPLATNIGTAELLIRALERGDLAWRSIVRGQTKGGEESKTER

SEQ ID NO: 29395 - protein, 77 aa, Glycine max
  misc_feature (25)..(25): Xaa can be any naturally occurring amino acid
  misc_feature (41)..(41): Xaa can be any naturally occurring amino acid
  misc_feature (48)..(48): Xaa can be any naturally occurring amino acid
  misc_feature (56)..(56): Xaa can be any naturally occurring amino acid
AVFPAEACGAVEVLACMVNMYPVTXLQPESKTPGVVIEVVXREYVQYXDAPTQVFXREACDDSSARFCQSEYQKGVG

SEQ ID NO: 29396 - protein, 342 aa, Bacteroides thetaiotaomicron
MKHIIIAVILTISNVFLGIAKPMKSQAEIYFAGGCFWGTEHFLKQIRGVESTQVGYANSTVANPSYEQVCSGKTNAAETVKVVYDPEEVNLSLLLNLYFQTIDPTSLNRQGNDRGTQYRTGIYYINKADLSTINQAIQALATQYNKPIAVEVEPLTNFYPAEVYHQDYLDKNPGGYCHINLALFEMARKANAPKPPTFQKPDDATLRKKLSAEQYAVTQKNATEPAFHNEFWNEHRPGIYVDITTGEPLFVSTDKFDSGCGWPSFSKPIQKELIAEKKDTTHGMIRTEVRSKTGDAHLGHVFTDGPKDKGGLRYCINSASLRFIPKEKMKEEGYGEYLPLIK

SEQ ID NO: 29397 - protein, 572 aa, Arabidopsis thaliana
  misc_feature (129)..(129): Xaa can be any naturally occurring amino acid
MADEIVPPATQLAAVSLENDGSTVQRAQFSNRVLIRTILDRPDGGAGLAGQTVRIGGWVKSGRDQGKRTFSFLAVNDGSCPANLQVMVDPSLYDVSNLVATGTCVTVDGVLKVPPKGKGTQQQIELNVXKVIDVGTVDASKYPLPKTKLTLETLRDVLHLRSRTNSISAVARIRNALAFATHSFFQEHSFLYIHTPIITTSDCEGAGEMFQATTLINYTERLEQDLIDNPPPTEADVEAARLIVIERGNVVAELKAAKASKEAITAAVAELKIAKETFAHIDERSRLRPGLPKKDGNIDYSKDFFGRQAFLTVSGQLQVETYACALSNVYTFGPTFRAENSHTSRHLAEFWMVEPEIAFADLEDDMNCAEAYVKYMCNWLLEKCYADMELMAKNFDSGCIDRLKLVASTPFGRITYTKAIELLEEAVAKGKEFDNNVEWGIDLASEHERYLTEVLFQKPLIVYNYPKGIKAFYMRLNDDEKTVAAMDVLVPKVGELIGGSQREERYDVIKKRIEEMGLPIEPYEWYLDLRRYGTVKHCGFGLGFERMILFATGLDNIRDVIPFPRYPGKADL

SEQ ID NO: 29398 - protein, 691 aa, Unknown
  Mesorhizobium sp. BNC1
MRVEIGLPYPLGATWDGSGVNVAVFSAHAEKIELCLFDAQGRREIRRIPLPEYTHEVWHGYFPDMRPGQVYGLRAYGPYDPANGHRFNPNKLLIDPYAKQLLGDIRWHDACFGYRVGGARQDLAIDRRDSAFVMPKCVVTDTAATWGNDVRPHRPWEETIIYEAHVKGMTALHPDVPEQFRGTFGGLADSRVIDYLVKLGITAIELLPVQAFFDDRYLVEKRLTNYWGYNTIGFFAPTPRYISPRGGLHEFKRMVRKLHEAGIEVILDVVYNHTAEGNELGPTLSFRGLDNASYYILGDDPRYYYDTTGCGNTLNLKHPRVLQMVMDSLRYWVEECHVDGFRFDLATALGRERDNFEPSSVFFDTVRQDPVLSRVKLIAEPWDLGPDGYQLGNFPPGWGEWNGAYRDWVRSFWRGDERVAPDLASGLLGSAAMFDRRGRRPWASVNFITAHDGFTLHDLYAYNERHNEANLEDNRDGHSDNRSWNCGAEGPTDDETIKALRAKMRRNAIATLLLSQGTPMVLMGDEVGRTQNGNNNAYCQDNEINWLAWENRDPDDEAFLQFVRRLIAYRRAHPRLRLKNFLHGNVVAGKYRDVSWLRPTGEPMTDEDWSDPGFKSFGLMLCDERGTCILILINGFHEPLGFSLPRELGAAGWKMIMRTDTGQWPVWEAMRSPHTLELADRSMVVLEGRVR

SEQ ID NO: 29399 - protein, 300 aa, Arabidopsis thaliana
  misc_feature (141)..(141): Xaa can be any naturally occurring amino acid
MGGSREFRAEEHSNQFHSIIAMAIWLGAIHFNVALVLCSLIFLPPSLSLMVLGLLSLFIFIPIDHRSKYGRKLARYICKHACNYFPVSLYVEDYEAFQPNRAYVFGYEPHSVLPIGVVALCDLTGFMPIPNIKVLASSAGXTAASRKNFTSLLDSGYSCVLVPGGVQETFHMQHDAENVFLSRRRGFVRIAMEQGSPLVPVFCFGQARVYKWWKPDCDLYLKLSRAIRFTPICFWGVFGSPLPCRQPMHVVVGKPIEVTKTLKPTDEEIAKFHGQYVEALRDLFERHKSRVGYDLELKIL

SEQ ID NO: 29400 - protein, 1115 aa, Unknown
  Mesorhizobium sp. BNC1
MNTMEKVASELMSPEEAEAVQVVPPAGPRPPDWYKDAVIYQLHIKAFHDSNGDGMGDFNGLMQRLDYVERLGVNTIWLLPFYPSPLRDDGYDIADYRSINPSYGTMRDFRRFVAEAHRRGIRVITELVINHTSDQHPWFQRARHAKKGSAARQFYVWNDDDERYPETRIIFLDTEKSNWTWDPVAGQFFWHRFYSHQPDLNFDNPRVLDAVIRIMRFWLDMGVDGLRLDAIPYLVERDGTNNENLPETHEILKKIRKALDEKYPDRMLLAEANQWPEDTRPYFGEGDECHMAFHFPLMPRIYMALAQEDRHPISDIMRQTPEIPESCQWAIFLRNHDELTLEMVTDRERDYLWRTYAEDVRARINLGIRRRLAPLMQNDRRKIELMNALLFSMPGTPIVYYGDELGMGDNIYLGDRDGVRTPMQWAPDRNGGFSRANPQMLYLPPIMDPVYGYQTINVEAQEADPSSLLNWVRRVIGVRKQHSAFGRGDFTMLYPRNRRILAYTRSDANETILCVANLSRSPQAVELDLSKYRNCVPIELVSQSPFPPIGDLPYMLTLTGYGTFWFVLASEAQAPEWHNNVPEPLPEFITLTMVDGRIERALEGRERRQLEQDVLPQFMQRQRWYGAKGEGIRSAGISDIAKLGDEGGLLTIVDVDLSVSGRQRYLLPLTVLWGEENVQFGAPKLSVTLARVRKGSRLGALIDGAYDDRFASELMRRMQENQEMQVPGGTLRFYGNEQLTAMHFEETPSPLMGEQSNVSVAFDRQVLLKIFRRLRPGDQPEVEVARFLTEVAGFRNTPAFLGMVEYEEQGARTVLASVSGFVENQGDAWGVFVHALERQIEDETLAPPAPAGATPAEGTTAQLLYPLDLLRRLGERTGEMHAALAIETDMEAFRCEPIRRADIASWVKDLKQQAASARAALERNKDRLPLNIRESVEHLLSLRQRIDRRISEFGKITPSGKKSRIHGDYHLGQVLVSKQDLYIIDFEGEPRRSLEERRGKSSPLRDVAGMLRSFDYAAWTAVRQVAARLPDQTRDGSSLARQWRERMSAEFLEGYRAAASVAQNQPADGATWEALLELFLLQKGFYEINYELSNRPDWVGIPVQGVLDLIERRSG

SEQ ID NO: 29401 - protein, 350 aa, Xanthomonas campestris
MDVAVPALPLHCTFEAADWQRLAQHWHAVALSSEVSEAPFKAMLLDEPLVLYRLGAELVAARDVCPHRGVPLSMGSADGAGVVCAYHGLRFGAGGRCNHIPASPNQNIPAKMRLHTYAVAERYGLIWVCLAKPAGVSAAEVQIPPMPGWDEDGFQQIVCPGFDIAGSAARQLEGFIDVAHFAFVHTATFAQPDKREVPAYTTTETPTGFNADYLSSVANYSVDMPLPDVDPGFQWLRHFEVHLPFTATLTIHFPVPGKRLVIMNAASPVSKHKTRLLVPIARNFDTHLPVEDVHAFNLRVFEEDRAMVEAQRPEYLPLDPLLEVHIPADRSSIAYRRGLRSQGYSDFFLR

SEQ ID NO: 29402 - protein, 468 aa, Klebsiella pneumoniae
MSKQQIGVVGMAVMGRNLALNIESRGYTVSVFNRSREKTEEVIAENPGKKLVPYYTVQEFVESLETPRRILLMVKAGAGTDSAIDSLKPYLDKGDIIIDGGNTFFQDTIRRNRELSAEGFNFIGTGVSGGEEGALKGPSIMPGGQKEAYELVAPILKQIAAVAEDGEPCVTYIGADGAGHYVKMVHNGIEYGDMQLIAEAYALLKGGLALSNEELAQTFTEWNEGELSSYLIDITKDIFTKKDEEGKYLVDVILDEAANKGTGKWTSQSSLDLGEPLSLITESVFARYISSLKDQRVAASKVLSGPQAQPAGDKAEFIEKVRRALYLGKIVSYAQGFSQLRAASDEYNWDLNYGEIAKIFRAGCIIRAQFLQKITDAYAQNAGIANLLLAPYFKQIADDYQQALRDVVAYAVQNGIPVPTFSAAIAYYDSYRSAVLPANLIQAQRDYFGAHTYKRTDKEGIFHTEWLE

SEQ ID NO: 29403 - protein, 195 aa, Unknown
  Silicibacter sp. TM1040
MRTAQVSRSTAETEISVSVNLDGSGTYDNQTGVGFFDHMLDQLSRHSLIDMTIRAKGDYHIDDHHTVEDTGIALGQALVQALGDKKGINRYGECHLPMDDAQVRAALDLSARPFLVWNVDLPTQKIGSFDTELVREFFQALATHGGITLHIDQIHGVNSHHIAEAAFKAVARALRTAVEVDPRKADAVPSTKGAL

SEQ ID NO: 29404 - protein, 326 aa, Santalum album
MPPQPNSPPDNVFPPDRCTSVRLGSKKRGESPAPDSRNKNNVKSSGISLLPPSAPTYPTPLQVISQSRTKIPSPTLGLPFPPLDPRKPPSGPFGNPNSPASLIPWRRWDHTPPLFNPPSDPPTPYGTPPTVRRSPSPPESASPSPSPGPPAATPTPRPSSPTSTPPTDGETPRPPGPRSPSPSPGPPSCSPSPKSPSPPASSPPRSRPGPPDYTTSPSPPTPRSVPPTPPASPSPPTAKPSPPSRGSSPSPPTSPTPTPRPPSYSPSPTPPSSRPSPPLRSPILTPPSPAAVPPIGRSPPSPIDPPCSSPEPSSPPTSPPTPSSPY

SEQ ID NO: 29405 - protein, 430 aa, Xylella fastidiosa
MLIASPVFFSGVAMFPRDARLDMYDPELAKAIAAEVRRQEDHVELIASENYCSTLVMQVQGSQLTNKYAEGYSGKRYYGGCEYVDIAEQLAIERAKQLFGADYANVQPHSGSQANQAVYFALLQPGDTILGMSLAHGGHLTHGANVNVSGKLFNAVQYGVNAQGLIDYEAVESLALEHRPKMVVAGFSAYSQKIDWVRFRAIADQVGAYLLVDMAHVAGLVAAGVYPNPLPHAHVVTSTTHKTLRGPRGGIIVAQAPQEALVKKLQSIVFPGIQGGPLMHVIAAKAVAFKEALEPAFKVYQQQVVKNAKAMAETLMLRGYKIVSGGTENHLMLVDMIGRDVSGRDAEGALGQAHITVNKNAVPDDPRSPFVTSGLRLGTPAVTTRGYQEQDCVDLAHWIADVLDAPADATVIAAVREKVAAQCKKYPVYR

SEQ ID NO: 29406 - protein, 452 aa, Ashbya gossypii
MSTLAESIAKKARVAGNVLKTLSNEQRTGVLRRIHDGLLAKKEDIRKANEADLETAAQNNLAPALVQRLNLFKGDKFEAMLQGILDVAALEDPVGKLQMVRELDEGLTLYKVTAPVGVMLIIFESRPEVIANISALCIKSGNAGILKGGKETVNTFRELAAVINLVLAESEPETGVPVHAVQLVESRSEVSDLLQQDEYIDLVVPRGSNALVKQIKASTKIPVLGHADGICSIYLDADADLAKAKRIVLDSKTNYCAACNAAESLLINPRCSGWEEVLAHLIIAGNVKLHVTSDVKEAFFAYAGDDAALKGNVVDAEEGDFSREFLSLDIAVKFIDSVQEAVIHINEHSSKHTDAIVTECKQTADFFLKGIDSAGVYWNASTRFADGFRYGFGTEVGISTSKIHARGPVGLDGLVTYQYQVRGTGQVASDYIGAGGDRAFVHKDLDPKNVAF

SEQ ID NO: 29407 - protein, 216 aa, Chlamydomonas reinhardtii
MSHKPDDDYDYLFKVVLIGDSGVGKSNLLSRFTRNEFSLESKSTIGVEFATRSIQVDGKTIKAQIWDTAGQERYRAITSAYYRGAVGALLVYDITKSVTFENVERWLKELRDHADSNIVIMLVGNKSDLKHLRDVQTEVAQAFCEREGLSFIETSALESTNVEKAFQQILTEIYHIVSKKVLDSEDNRPKIGEGRDVIVIDNAHDDGGKKKGGCCS

SEQ ID NO: 29408 - protein, 330 aa, Yersinia pestis
MTLQQKLTQFPRLDLVGNATPLEKLSRLSDYLGREIYIKRDDVTPVALGGNKLRKLEFLAADALRQGADTLVTAGAIQSNHVRQTAAVAAKLGLHCVALLENPIGTEQANYLTNGNRLLLDLFNVDVVMCEALNDPNQQLAELATRVEAQGFRPYVVPIGGSNALGALGYVQCSLEIAAQAAGNVAFSSVVVASGSAGTHAGLAVGLQQLLPDAELIGVTVSRSADEQRPKVAQIQQALATSLGMTDPLAKITLWDSYFAPQYGMPNEEGIAAIKLLARLEGILLDPVYTGKAMAGLLDGIEQQKFCDKGPILFIHTGGAPALFAYHPQV

SEQ ID NO: 29409 - protein, 704 aa, Mannheimia succiniciproducens
MNPIVKQFKYGQHTVTLETGAIARQATAAVMASMDDTTVFVSVVAKKDVKEGQDFFPLTVDYQERTYAAGKIPGGFFKREGRPSEGETLIARLIDRPIRPLFPEGFLNEIQIIATVVSVNPQISPDLVAMIGASAALSLSGVPFNGPIGAARVGFINDQFVLNPTMAEQKQSRLDLVVAGTDKAVLMVESEADILTEEQMLAAVVFGHQQQQVVVEAIKEFVAEAGKPRWDWVAPEPDSALISKVKAIAENRLGDAYRITEKQVRYEQIDAIKADVIAQITAEDEEVSEGKIVDIFTALESQIVRGRIIAGEPRIDGRTVDTVRALDICTGVLPRTHGSAIFTRGETQSLAVVTLGTERDAQILDELTGERQDTFLFHYNFPPYSVGETGRVGSPKRREIGHGRLAKRGVAAVMPSISEFPYVVRVVSEITESNGSSSMASVCGASLALMDAGVPVKSAVAGIAMGLVKEDDKFVVLSDILGDEDHLGDMDFKVAGTRTGVTALQMDIKIEGITPEIMQIALNQAKSARMHILGVMEQAISAPRAEISEFAPRIYTMKIDPKKIKDVIGKGGATIRALTEETGTSIDIDDDGTVKIAAVDGNAVKTVMARIEDITAEVEAGAVYTGKVTRLADFGAFVAIVGNKEGLVHISQIAEERVEKVSDYLQVGQEVQVKVVEIDRQGRIRLTMRDLGSKEESQELSVEQ

SEQ ID NO: 29410 - protein, 183 aa, Brassica napus
SFCPGFGYWAGSEFGPICSQDISGGGETSRKKLRLSKDQSAFLEDTFKEHNTLNPKQKVALAKKLNMTARQVEVWFQNRRARTKLKQTEVDCEYLKRCVEKLTEENRRLQKEAMELRTLKLSPQFYGQMTPPTTLIMCPSCERVAGPSSNHHQTHRPVAINPWVARAGQVAHGLDFEALRPRS

SEQ ID NO: 29411 - protein, 635 aa, Arabidopsis thaliana
MEGTLDEENLVFETTKGIKPIKSFDDMGMNDKVLRGVYDYGYKKPSEIQQRALVPILKGRDVIAQAQSGTGKTSMIAISVCQIVNISSRKVQVLVLSPSRELASQTEKTIQAIGAHTNIQAHACIGGKSIGEDIKKLERGVHAVSGTPGRVYDMIKRGSLQTKAVKLLVLDESDEMLSKGLKDQIYDVYRALPHDIQVCLISATLPQEILEMTEKFMTDPVRILVKPDELTLEGIKQYYVDVDKEEWKFDTLCDLYGRLTINQAIIFCNTRQKVDWLTEKMRSSNFIVSSMHGDKRQKERDDIMNQFRSFKSRVLIASDVWARGIDVQTVSHVINYDIPNNPELYIHRIGRAGRFGREGVAINFVKSSDMKDLKDIERHYGNEDEDHERAYEASQFSFATYSFRNLFSIFFFSSDITSLSVYLGGDTLSEQRRTMFIQTQSTPNPSSLMFSPGKPVMEIGSADFPNSRSAMSSPLAKAIFAIDGVVRVFYGSDFVTVTKSDDVTWDILKPDIFAVVMDFYSSGQPLFLDSQATAAKDTAIHEDDSETVAMIKELLETRIRPSVQDDGGDIEYCGFDTETGIVKLRMQGACSGCPSSSVTLKSGIENMLMHYVSEVKGVEQEFDGEEEGTSSGPME

SEQ ID NO: 29412 - protein, 382 aa, Unknown
  Rhodococcus sp. RHA1
MFELIDEWGPEKVVCVSDARTGMRGVLVIDNTARGMGKGGTRMSTTVSVGEVARLARNMTWKWAGVDLFYGGAKAGIWADPTASSKEAVLRAFVRALRNEVPEEYVFGLDVGLTEKDAAIMLDEVGGRGGAVGTPHALGGLPYDQLGVTGHGVAESADAAAQALGLSTGSLSVSIQGFGAVGAASAKRLAELGATIVAVSTSQGGIHNPDGLDVATLLDLRDQYGDGLVDQYSDAKPLAAGEELSVTADILIPAALQDVIDADLARTLPAKIVVEGANLPSSPEAQSVLFDRGVTVVPDFIANAGGVVAAAVAMDARYSGIRPEPAAVFDNISNKLRASTIDTLDASKAQGRTTHEVARATAQERVREAMVLRGRSPQNAAF

SEQ ID NO: 29413 - protein, 1034 aa, Bacillus megaterium
MLKTGKKFHYTAPANGYPEWNNNPEIFQLNRSKAHALLMPYQTVEEALKNDRKSSVYYQSLKGSWYFHFAENADARVKNFLAPEFSYEKWDSISVPSHWQLQGYDYPQYTNVTYPWVENEELEPPFAPTKYNPVGQYIRTFTPKPEWKDQPVYVSFQGVESAFYVWINGEFVGYSEDSFTPAEFDITSYLQEDENTIAVEVYRWSDASWLEDQDFWRMSGIFRDVYLYSTPPVHIYDFSVRSSLDNNYQDGELIVSADILNYFEHDTQGLTFEATLYDANGQEVLQAPLQINLSVSDQRTVSLRTHIKSPKKWSAESPHLYTLVLSLKNSAGSIIETESCKVGFRTFELKNGLMTINGKRIVLRGVNRHEFDSVKGRAGITREDMLHDILLMKQHNINAVRTSHYPNDSVWYELCDEYGLYVIDETNLETHGTWTYLQEGEQKAVPGSKPEWKENVLDRCRSMYERDKNHPSIIIWSLGNESFGGENFHHMYTFFKEKDSARLVHYEGIFHHRDYDASDIESTMYVKPADVERYALMNPKKPYILCEYSHAMGNSCGNLYKYWELFDQYPILQGGFIWDWKDQALQTTAEDGTSYLAYGGDFGDTPNDGNFCGNGLIFADGTASPKIAEVKKCYQPVKWTAVDAAKGKFSVQNKHLFTNLNAYDFVWTVEKNGELVEKHASLLNVAPDGTEELTLSYPLYEQENETDEFVLTLSLRLSKDTAWASAGYEVAYEQFVLPAKTAVPSVKAAHPALTVDQNEQTLTVTGTNFTAIFDKRKGQFISYNYEHTELLASGFRPNFWRAVTDNDLGNKLHERCQTWRQASLEQHVQNISVQPQIDFVIISVELALDNSLASCYVTYTLYNDGEMKIEQSLAPSETMPEIPEIGMLFMMNAAFDSLTWYGRGPHENYWDRKTGAKLALHKGSVKEQVTPYLRPQECGNKTDVRWATITNDQGRGFLIKGLPTVELNALPYSPFELEAYDHFYKLPSSDSVTVRVNYKQMGVGGDDSWGAKTHPDYTLYANRSYTNTFTLKPL

SEQ ID NO: 29414 - protein, 290 aa, Oceanobacillus iheyensis
MQNKTIIVTGANTGMGLATTIELAKKGIHVIMACRDTKRGNEAKEKAMEESNSTNISLYQCDLGSMESISKFADQIKEDFDKIDGLINNAGVVSLKHTKTEDGFESMTGVNHLGHFLLTHLLLDVLKKSEQARIINVASGAYKAGTLDYNDMHFNNRSFNVIKGYGQSKLCNILFTLELNKHLEGTNVSTFALHPGAVSTSLGVDRQTGFGEKVHLLLRPFFLTSEEGAETAIYLATEPKIDHLSGRYFYKKKLQPTKYNKVNEDEAKKLWDWSIKELGMEHKAIEEVAP

SEQ ID NO: 29415 - protein, 399 aa, Arabidopsis thaliana
MADSQRLSTASGVKDGQPPWKKKKLSNDTTSNPSLPYDVILIILARVSRSYYTNLSLVSKSFRSILTSPELYKTRTLLGKTENFLYVCLRFPDEANPRWFTLYRKPNQTLTDHTTKKKKKKKKKEEKSSVNLLAPISILNSHPVEWSAIISVDHYLYAISADIEKAPYSNVPYLDCRTHTWNEAPRMRLAHTNSEFEGIVYLPGSFESPDSLNCVEVYNTMTQTWKPVPPEKRMFKLENLEKKIYYKSFHLDSRAGKGLSLSYKSKHLTCGLVVLDTVDSYLRSSCMIENIAYFYRKGNFIWRGLDGKILVYGKIEGLEGLPKFSRYSSVQLAEYGGKLVVLWDKYVPASGYKEKMIWCAEISLEKRNGKEIWGNVEWFDAVLTVPKSYKILCATAATL

SEQ ID NO: 29416 - protein, 371 aa, Zea mays
CELRQREREEETRNSASGMATGPEKKAASTTELPAPSGWTKKVAPTRGGRFEVIFVSPTGEEVKSKRQLTQYLKAHPGGPASSEFDWGTSDTPRRSARLSEKVKATESPEGEKTPKRGRSSSKRGKKEEKEDTEAANEAGEDGASEEGKGTDVEMKDAENAEDEKKEVPNADAAEKTEEGEDKKEEAPAVDAAEKTEEGEDKREEEAPAVDAAEKTGEKEVAPAVDATEETEKSTEGQAQPNYVAAPESEYKGDGKPGESEAAPLAFVDETAPHVIIGEEKKEENTENENSQAAESAVPSLASLEGEKKENGGAPEQPALPVAETKADAPPAEAEKGAENSGQPNTGSQEPKAANCDEGQIQPGASAVRCT

SEQ ID NO: 29417 - protein, 527 aa, Unknown
  Rhodococcus sp. RHA1
MITHERKFAISPGPGPHFRPRPVTVSRRPITPATTGAQLALSISCPTRPLERLMSTLEQPPETLQKSLKQRHLTMIAIGGVIGAGLFVGSSALLHTSGPAAFVSYAITGVVIVLVMRMLGEMATTNPSTGSFAGYARKAFGGWAGFTTGWLYWFFWVVAVGAEAVIGGKLLQRWIDLPSWVMAVVLLLAMVATNLRSVRNFGEFEYWFAGIKVAAILLFLGLGAAYVFGLWPSHSADFSNLTDHGGFTPNGWTVILSGVVVAVFSMVGPEIATIAAAESAEPEKAVAKATNSVIARIGFFYIGSVLLLAIIVPWTDVKVGQSPFVDALTHMGIPGGPDIMNAVVLVAVLSCLNSGLYTSSRMLFTLAHKGDAPQSIARLDKHGVPRNSLLLATLVGFACIGLDYLSPDTVFAFLLNASGATILMVYLMIAMSQIKLRGLMTREEVAQLRLKMWLFPYLSILAAGGILAVLVSMFYVESSRSQLSLSVGALIATLIAYRLRRRINPQNPLANNISAPAPGPITKPASK

SEQ ID NO: 29418 - protein, 285 aa, Gossypium hirsutum
MEVPFFPTLFSCIKGLVVQQALFSTLEDWLVKHPKILQFSWENGQTPASSHRFLTLTVLSYISFTFVLSQLSRPSLSHPLLKSIAAVHNIFLLTLSFTMALGCLVSIFSQVPNFNTLVCFPRGTSPSGPLFFWAYIFYLSKIVEFMDTLLIILSGSMKRLSFLHVYHHSMVVIMCYICLDSAQSSVPMVLITNCVVHVVMYSYYLLCTLGMHPKWKKMVTDFQLVQFRLSFLIMAMLVFYHFTASGCSGILSWCFNGAFNVSLLYLFSDFHAKSYSTNAKVFKGN

SEQ ID NO: 29419 - protein, 428 aa, Bdellovibrio bacteriovorus
MKALGRHILVEFSGCNAEVLNDVSIIERSMVEAAQIAGATVINSTFHHFSPWGVSGVVVIQESHLAIHTWPEYRYAAVDLFTCGDSVDPWVSFEHLKKAFQANYSALEMNRGSLHVIQKSDFQPKIMREKPSFDLSKGHQIDRNVWFTDKDENQALSLRYTGDVLFDETNPFQRVRVLDSYSHGKFLAINNMVMCTERDEYHYHEMITHPVMQTHGNAKNVLVIGGGDGGTIRELFKYNVDNVTMVEIDEAVVRASKEHLPKIACEFNNPKLNLIIGDGIQFVKDAPANSYDVIIVDGSDPVGPAKGLFTAEFYNNCKNALKDGGLVITQGESPMFHEGTFVELNHCLKGIFGKQSVHTMLFHATTYPSGMWSLQVAVKGSKHPAKDFNKDQAAKFAQDKGLKYYNEDLHTAAFSLPTFVKTMLGDNA

SEQ ID NO: 29420 - protein, 308 aa, Ceratopteris richardii
  misc_feature (1)..(1): Xaa can be any naturally occurring amino acid
  misc_feature (85)..(85): Xaa can be any naturally occurring amino acid
XQITDNRKHILLGVQTLRAMATAAFRTSSSPNVELSIFGCISNSISSSGNGMDNRTANRSEPSENLNLLLSSSGPKPLIESTLKXPPKQLNLLPVRSPCQKPAEGYSRWNAISDAHVNSKGIDMNQIPCSSESEDEDEAEAPSLKLRFLAGEGKRSEMAALGSGMADPGERERGLLEVSSRNSDEEESGSARKKLRLSKEQSALLEESFKEHSTLNPKQKSLLAKQLNLRPRQVEVWFQNRRARTKLKQTEVDCELLKRCCESLTEENRRLQKEVAELRALKGGSPLCYIPRLLHAFACSHINNVPLL

SEQ ID NO: 29421 - protein, 329 aa, Robiginitalea biformata
MRFAVLGGGSWATAIVKMLCENLDQVTWYMRNPDAIEHIRREGHNPNYLSSVEFNTDQLRLTDTIDEAVRDADLLIFAIPSAFLVRELKQLSVPLGGKTLFSAIKGIVPETGKIVGEHLHETYDIAYDDIGVITGPCHAEEVALERLSYLTIACSDKKKARMVARALSSSYIKTKVTKDIIGTEYAAMLKNIYAIAAGIAHGLGYGDNFQSVLMSNAIREMKRYTKRLYNIDRNINHSAYLGDLLVTGYSTFSRNRMFGNMIGKGYTVKSAMMEMSMVAEGYYAVKSAHAIKEDFPKKVKTPIIDAVYKVLYEQKNAKKTFAALADRMS

SEQ ID NO: 29422 - protein, 610 aa, Pseudomonas chlororaphis
MCGLTGWVDYTRRLEGEDPAIRAMTNTLALRGPDAEGIWKHRHALLGHRRLAVIDLSGGTQPMVYRFADGQEVSLVYTGEVYNHDALRDQLRQAGHVFQTRSDTEVVLHAYLEWGERCCDHLTGMFAFALFDGRDGHLLLVRDRLGIKPLFYARHREGLLFGSETKAILAHPEFTTGLEVTGLVDVLTLSKGTAQTPFRNLMELLPGHFLSWRPNGQMKIQSYWKVRRQEHQHDLQTTVQQTRELVTHALGSQLHADVPVCSLLSGGLDSTTLTAIAQRIVKAKTGGNINSFSVDFTGQAEQFKSDDLRPDQDQPFALLAAEFIGSRHQTVLIDNEELVSYLAREEVFRARELPFTFGDMDTSLNLLFREIRKHSTVAISGEGADEVFGGYGWFRDPKVIASASFPWSSRVKLPAGFINADFNRQCDLAQYQQASYDDALLQVEHLAQDSPHERRMRELCHMHLKRWMVMLLDRKDRLSMCNSLEVRVPFTDHELVEYIYNVPWSIKSKDGEEKWLLKQACADFVPEAVLKRRKSPYPTSADLGYERFLRQSARQLLQDTGNPVFGIVSHAYMAEELRQPEGYFNTQISRHSLETALALDAWLRLHKISL

SEQ ID NO: 29423 - protein, 212 aa, Ceratopteris richardii
YGKPVDSFWSFTGGQSTVKREREKVGSETENTHNSASYPLCEVGSRGSDEEEGNSTRKKLRLSKEQSALLEESFKEYNTLNSKQKSALAKQLNLRPRQVEVWFQNRRARTKLKQTEVDCELLKRCCESLTEENRRLQKEVQELRALKVTAPRVIAHDYYTPIPAATLAMCPSCERLATIEPPPRPSSKQHVSAIPFASLAFNQHHPEPSAAC

SEQ ID NO: 29424 - protein, 1046 aa, Bordetella bronchiseptica
MKRMLFNATHQEELRVAIVDGQKLIDLDIETAGREQRKGNIYKGVITRIEPGLEACFVNYGEDRHGFLPFKEVARSFFKEGVDVRTARIQDALREGQELIVQVEKEERGNKGAALTTFISLAGRYLVLMPNNPRGGGVSRRVEGEDRQELRDTMEQLDVPQGMSIIARTAGIGRNVDELQWDLSYLLQLWTAIDGAARDNAAPILIYLESSLVIRAIRDYFSPEIGEILIDTDEIADQATAFMSVVMPDNVQRVKRYRDDIPLFSRFQIEHQIETAYSRTVQLPSGGAVVIDHTEALVAVDVNSARSTRGADIEETALRTNLEAAEEVARQLRLRDLGGLIVIDFIDMEDSKNQRAVEQRLRDALHFDRARVQMGKISRFGLMELSRQRLRPALNEGSHITCPRCNGTGVIRDAESSALHVLRLLQEEAMKENTAAVHAQVPVDVATFLLNEKRADITKMEARLKVNLVLIPNKHLETPHHHIERLRHDDPRLEETKTSFELAEAPATDLTWQPREHEIKARPEALVKGITPAQPAPVSTPAPAKAPAAAAATQGGLGGWFKRLTSWLGGSAEPAKTETKSEDEKRGANRARRAHDGQDRRGERHGSDRNRHRRNEPRGDHAESGDARHHVRGGRRQEERGERGERGQKEARTEREQTQQQQAAGQPRQERPSTAETGEEGGRGRGRRGRGRGRREEGQTDTPMTEQENMVAALAETVAAALPEKRQAAPAPAAAAAAALTVAEAASSNELAPVAEDADGIDGIDANVDAGAETGSDPERKRRRRRSRRGRRSQEDGSTVNAEGVEGADDEQVDAPAGVADIETPAQPAESETVAAPVAVSVAADEPAATIETAAAEPAAPQATEAPRAEPVVAAADTAPQAVQPVQAELTPVETPQAQAQPAEPAAAAPVETAPVETAPVETAPVETAPVETAPAATTPVEPAEQAAAPVEAEAPVAQPEKTPEPAAVRPAEAIVMPAQAAAPATGALHDVLDAAGLTWVETDPERHAQTQMRIAAAAAPVRLGRERKPVASVSNEPLVQVETRH

SEQ ID NO: 29425 - protein, 295 aa, Methylococcus capsulatus
MKSTIELALVQQACNGSREQNLAASVEGIRRSKAKGADLVMLPELHLGPYFCQTEDCSCFDGAETIPGPTTAELGSVARELGVVVVASLFERRAPGLYHNTAVVLDSDGSLAGKYRKMHIPDDPGYYEKFYFTPGDLGFRPIDTSVGRLGVLVCWDQWYPEAARLMALAGADLLLYPTAIGWNPADDEVERSRQLEAWITVQRGHAVANGLTVAACNRIGSEPDPSGQTPGILFWGNSFAAGPQGEFLCRAGSADTELLMVTVDRKRSEDVRRIWPFLRDRRIDGYDGLLRRYLD

SEQ ID NO: 29426 - protein, 455 aa, Zea mays
RSATVPGVGLVHAPFSLLPAHFPESFWRQACELAPVFNELVDRVSMDGNFLQNALSKTRQVDDFTSRLLEIHRKMMEINKEENIRLGLHRSDYMLDSETSSLLQIELNTISASFPGLGSLVSDLHRSLIKQYGTSLSLEHKRVPANAASTQFSGALAQAWSEFNIDSAVIMMIVQPEERNMYDQYWLSKHLQDSHGITTIRKTLSQVEAEGQVLPDGTLLVVGQKVAVVYFRAGYTPNDYPSEAEWSARLMMEQSSAVKCPSISYHLVGTKKIQQELAKPNVLERFLKSEEEIEKVRKCFAGLWSLDDEDIIKTAVEKPELFVLKPQREGGGNNIYGLDLRETLVRLQKEGGDALAAYILMQRIFPKASPAYLVRGGVCHEGLAISELGIYGAYLRNKDKVVINEQCGYLMRTKVSSSDEGGVAAGFAVLDSLYLTGKVMFQSIDLFTHHFCLDR

SEQ ID NO: 29427 - protein, 332 aa, Plantago major
MAKDPVRVLVTGAAGQIGYALVPMIARGIMLGPDQPVILHMLDIAPAAEALNGVKMELVDAAFPLLKGVVATTDAVEACTGVNVAVMVGGFPRKEGMERKDVMSKNVSIYKSQASALEKHAAANCKVLVVANPANTNALILKEFAPSIPEKNITCLTRLDHNRALGQVSERLSVQVSDVKNCIIWGNHSSSQYPDVNHATVKTPAGDKPVRELVADDQWLNTEFISTVQQRGAAIIKARKFSSALSAASSACDHIRDWVLGTPEGTWVSMGVYSDGSYNVPAGLIYSFPVTCKNGEWSIVQGLPIDEFSRKKLDLTAQELSEEKELAYSCLS

SEQ ID NO: 29428 - protein, 575 aa, Desulfovibrio desulfuricans
MVSLTTADNLPRSGGNQLNPEEPDRIPVYFETKPKEYSMFCNQCEQTAKGTGCTAMGVCGKQPEVSDLQDATVYALRGLAIAAQDAAAKGVREQGMGHYTAARLFSTLTNVNFDPDRFVPWVHEITAMRDDLVRKAGLSYTSGPAAFVPGADAAAIVQQAAEHGTLTLAPDEDIRSCMQILLYGMKGVAAYADHAAILGQEDNAVYDFLYKGLAAGFDGKARDLNDWVGLLLECGNVNLRTMELLDAGNTGTYGHPVPTEVPLGHRKGKAILVSGHDLRDLHELLKQTEGTGINIYTHGEMLPCHGYPELKKFPHFYGHFGTAWQNQHKEFPQFPGAILFTTNCIQKPQASYQDNVFTTGLVGWPGLTHCENRDFSAVIKRAQELPGFTEDAPGKTVMTGFGHNAVLGVAGAVVDAVKSGAIRHFFLVGGCDGAKPGRNYYTEFVEKAPADTVILTLACGKFRFFDKELGTIGGIPRLLDVGQCNDAYSAIQIAVALAKAFDCGVNDLPLSLVLSWYEQKAVAILLTLLALGIKDIRLGPSLPAFVSPNVLNFLVENYNIKPISTAEEDLKAILG

SEQ ID NO: 29429 - protein, 250 aa, Brassica napus
MGRRPARCYRQIKGKPYPKSRYCRGVPDPKIRIYDVGMKKKGVDEFPFCVHLVSWEKENVSSEALEAARIACNKYMVKSAGKDAFHLRIRVHPFHVLRINKMLSCAGADRLQTGMRGAFGKALGTCARVAIGQVLLSVRCKDAHGHHAQEALRRAKFKFPGRQKIIVSRKWGFTKFNRADFTKLRQEKRVVPDGVNAKFFSCHGPWANRQPGTAFGRPPIEVSELNNISLKLFYPGKYGLTVYTFSILNL

SEQ ID NO: 29430 - protein, 132 aa, Candida albicans
MSMYTSRLATEYVPLSEIKRPIPPVLDYQKIDAMLSTLKGVPMESATCKVEDITAGELPPIDVFKIRENGKNFYFAFGGCHRFQAYDRISKETEKEVMVKSRILPATRKSLRIYLGASVDALFDSVDSESSS

SEQ ID NO: 29431 - protein, 471 aa, Oryza sativa
MESNGGGGGSPKEAAVVVPSSGDATLGGHLARRLVQVGVSDVFAVPGDFNLTLLDHLLPRPGALLPLPEALQPGQPPRRARRHPRLPRQGRQARPRRGAQAPRRQGRRGLRGPRRRQRPRGGRHAVRQGAGAGDAAALHRDLLGRGQHGLLRGDRGVRGRLPVRGAHLQRLQLRGVLVPAEEGEGGGGAARPRDRRQWPRVRVRDDEGLPVGAGQARPEEHDGVRQLQEDLRAGGTAAGVRGRGGAAGERAVQAHTEDDRWHGDRGGDGGDGGLVVQLPEAAAARGLRVRVPDAVRLHRVVGGGAAGLRAGCPKTGGGLHRRRQLPGDGAGRVDDAALRAAEHHLPHQQRRVHHRGGDPRRAVQRDQELGLRGPRQRHPQRRGAVLGHPGAVRGGAGGGHRDGHGGQGGQPLLHRGGGAQGRHQQGAPRMGLQSLRRQLQAAQPAVVPPLPFILDPGPICTYLLPFIYKFR

SEQ ID NO: 29432 - protein, 448 aa, Oryza sativa
GLVVGDRAEPRSGTIPGVGLVHAPFALLPTRFPASFWKQARELAPIFNDLVDRVSLDGEFLQDSLSRTRQVDDFTSRLLDIHAKMMEVNKEEDIRLGLHRSDYMLDSGTNSLLQIELNTISSSFPGLSSLVSELHRTLLNRHGKVLGLDSKRIPQNWAATQFAEALSMAWTEFNNKSAVIMMVVQPEERNMYDQYWLINHLKESHGVKTIRKTLAQVEAEGQVLPDGTPVVDGQTVSVVYFRAGYSPNDYPSEAEWRARLLMEQSSAIKCPSISYHLVGTKKIQQELAKPNILERFLNNKEDIAKLRKCFAGLWSLDNEEIVKTAIEKPDLFVLKPQREGGGNNIYGYDLRETLVRLQKEQGEALAAYILMQRIFPRASLTHLVQGGVCFEDLTISELGIFGAYLRNKDKVVLNNQCGYLMRTKVSSSNEGGVAAGFAVLDSILLTDE

SEQ ID NO: 29433 - protein, 144 aa, Glycine max
MGAFTEKQEALVSSSFEAFKANIPQYSVVFYNSILEKAPAAKDLFSFLANGVDPTNPKLTGHAEKLFALVRDSAGQLKTNGTVVADAALVSIHAQKAVTDPQFVVVKEALLKTIKEAVGGNWSDELSSAWEVAYDELAAAIKKA

SEQ ID NO: 29434 - protein, 373 aa, Campylobacter jejuni
MEISYYEILEITQNADKETIKKAYRKMALKYHPDRNQGDKEAEDKFKLVNEAYEVLSNDEKRAIYDRYGKDALKGGGFGSSSSGFGGFEDLGDIFSSFFGEGFGSSRRRKSSNDEKIPSDFIVNLKLSFKEAVFGCKKNIDFTYKCSCKTCNGTGAKDGKLQTCPKCQGRGQVGVSQGFITFAQTCPDCQGIGEKASEKCSDCKGLGYNESKNSVELNIPEGVDTGMKLRVNAKGNILKNGTRGDMYVKIIAAEDDTFIRDDDDIYIEFPVFFTQAILGESIKVPTIRGEATLNLPKGAKDGQRFVLEKEGVKDVHSSRIGNQIVQISIKFPTSLNDEQKELLEKLSESFGIKDGMHQEQKGLFEKIANWFKS

SEQ ID NO: 29435 - protein, 677 aa, Geobacter metallireducens
MNISLVFPPFHLQSLYNLPPLGLISLATVLGEAGHRAVIRDLVLALRQGSLGMGKELYGEAARMILRDDPDLVGFSAQCTTFPAVVRIARLLKEQKPDLRIVAGGHNVSFLDVPTLERFPWIDAVVRGEGEVTFRELAASFAVGNDPAEVAGVTWRRGTEIVRNPDRELIADLDTLPLPDYTLVPPLASYRDACGIPRSIAILEVGRGCPHRCVYCSESVMWRRRTRTFSIPRLIREMEELHGRFGAECLVLAYDQFTADRRFVEEFCNRVIDARLNRVPWYCISRLDSLDRPLLDLMREAGCESMCYGIDSGSRRTLAFIGKEIDEGILYQRVRETTEAGMVPTLSFVIGFPEEEREDIDQTLFLALKAGVQGNSAPLVQLPTVLAGTELHRRYTGRLVREVDTYFSLGLEFDHGRRLADDERLIDADPFLFSSFYNLPCAGVPLAELDRIARWFPLILNGYPKSFILLSLALGRPPSNLFREILSRLEEDGWREDDPTAETAFLERFPCHAEGLMAGSASWPHFAEILTYETLALRATHRGPPRADGAGPLKGDPAGECRPVLREEVTVSEFRRNLPAIIADLKSGIFRESYPPEPTLLIFYPSGERLEVMEINRFGKDFLLLCNGLATCEEIAATLYGEYGDAMDSGAFSEECKDALTVFTGMGLVRDGAAPAP

SEQ ID NO: 29436 - protein, 73 aa, Streptomyces coelicolor
MAKKQGAIEIEGTVVESLPNAMFKVELQNGHQVLAHISGKMRMHYIRILPDDRVVVELSPYDLTRGRIVYRYK

SEQ ID NO: 29437 - protein, 271 aa, Silene latifolia
  misc_feature (92)..(92): Xaa can be any naturally occurring amino acid
KIMAHPHYPRLISAFVNCQKVGAPPEVVARLEEAEAMAMNQGGGGGGGYIGEDPGLDQFMEAYSEMLTKYEQELSKPFKEAMLFLSKIDCQXKALTLSSSLDSPSSDLVPGAHDDAGTGRNGSSEDEIDVNNNFIDPSAEDRELKGQLLRKYSGYLGSLRQEFLKKRKKGKLPKEARQQLLDWWTRHYKWPYPSESQKVALAEETGLDQKQINNWFINQRKRHWKPSEDMQFVVMDAAAAAAHSHGHPHYTYMDPATLANHFPMDVSSTLM

SEQ ID NO: 29438 - protein, 276 aa, Silene latifolia
  misc_feature (62)..(62): Xaa can be any naturally occurring amino acid
KIMAHPHYPRLLSAFVNCQKVGAPAEVVARLEEAEAAMTVSQGSRSGSGSGSGGQGYIIGEXPALDQFMEAYSEMLTKYEQELTKPFKEAMLFLSRIESQFKTLTLSSSSDSPSSGICGDIGERNGSSEEDIDVNNNLIDPCVEDRELKGQLLRKYSGYLGSLRQEFLKKRKKGKLPKEARQQLLDWWSRHYKWPYPSESQKLALAEETGLDQKQINNWFINQRKRHWKPSEDMQFVVMDAAAAHAHSHGHPHYGYMDNSLPNTFPMDVHVPPTLI

SEQ ID NO: 29439 - protein, 188 aa, Arabidopsis thaliana
MALEKHIEKVLFSDEVIAHRVNQLGIDITSDFSGDSEETPIFVGVATGACLFLADLVRRIDLPIAIDFIRAESYGSGTVSSGVPRVSFDLKLDITNKHVVLVEDIVDTGNTLSCLIEHMKAKKASSVSVCTLLDKPSRRKVHYKLVGKGKFYSGFECPDEFVVGYGMDFAEQYRNLSYTGVLKPEYYM

SEQ ID NO: 29440 - protein, 123 aa, Brassica napus
MAKYNEIAKKKREAKADRKRAIHGDPLTNKPKSRAPVVSVSGKRQKKLLRKWRREQKEMVEKGLVTMEDVEMASADAVSEESKKSPRKFNVKKTLKLNKLKNKGKKNKSQKAVSQVSADQMLE

SEQ ID NO: 29441 - protein, 586 aa, Oenococcus oeni
MTKMIAGRALVKALEDWGVDHVYGIPGGSINHTVEGLYLEQDKVKYIQVRHEEVGALAASADAKFTGKIGVAFGSAGPGATHLFNGLYDAKMDHVPLLAIIGQVPQETMNTNYFQEMDEVPLFSDVSVYNRTVTTAEQIPYVINQAIREAYRQKGVATVVLPENLAAKEIDYKETKTPKVVANNFSQKVDSKAVSDTLAMLKAAKHPLIYAGRGLLGARDVLTKFSEQFNIPVMNTVPATGVISTDDPNFIGTFGRLGSKSGFEALQHTDLILFLASEFPFAGFWPKNIKVIEVNNNPFDIGKTVDVDYAVISDAKSYLQALINTGQTLPAGNWLKANQENKRNWDNWLAELAKDESDGLNPESVTAKIASMVGPNDTYAVDTGNVSEWGARGLPMNHNQRFAISGLFATMGFGLPGGLAGALSVPDGQAWSLSGDGGFSMVVQDLITEVRYGLPVINIVFSNDRFGFIYHEQVQTKQHFYGVDLTGADWAKVSEGLGAISFTVKTIADIDQVFTKIKKLQESGNKKPIVVNAVIKKDDPFPTDYMPLDPKLYGQDAVDQYAEKYHFDLEKQPSLGALLRAQGDNL

SEQ ID NO: 29442 - protein, 129 aa, Yersinia pseudotuberculosis
IGVVGMAVMGSNLALNIESRGYSVSILNRSSDKTDEVVAENPGKNLVPSYTVEEFVDSLEKPRRILLMVKAGEATDKTIASLTPHLDKGDILIDGGNTYYKDTIRRNRELSAQGFNFIGTAVSGGEEGP

SEQ ID NO: 29443 - protein, 225 aa, Arabidopsis thaliana
MEAALSIFKLSFLLTLLSGGSDLIDSLPPNCNRAECPSYEVVHAGNGYEIHRYNTTVWISTEPIQDISLNEASGNGWNQLSDYMNGNNDYHQRIEIALPYITQVSQNLSTFIVSFFVPKAFQPDPPPGNNLHVQRWDSRYVAVKQISGYVADHKIGKQVAELKASLQGTVWAKAIEKSRETGGVGSAWAYTVAQFSWPFQWSQRVNEIWFPFEMEDEETVSIVTQ

SEQ ID NO: 29444 - protein, 478 aa, Vibrio fischeri
MKKQWTRRSAAAIAMVTTLLLSSHSFAASENNERVDPRNEAYAKDHADQYDSWRSTSDSVQIEDALAEDPNMVILWAGYGFAKDYNKARGHFYAVDDVRQTLRTGGPTDENSGPMPMACWSCKSPDVGRVIEEQGEDGYFSGKWARLGSEIQNPIGCADCHDTRSEEFKNGGPALALTKPHVERAMDAIGKPFGDQSRLDQQAAVCGQCHVEYYFTGKTKAVKFPWDKGTTVDEMEEYYDEIGFKDWTHKVSKAPMLKAQHPGYETWRDGIHGKNKVTCVDCHMPKVTKEDGTVYTDHKVGNPFDRFEDTCANCHTQSKEMLQSVVATRKAQVLKMKLTAERQIVAAHFEAGAAWDAGATEKEMAPILQDIRHAQWRWDYAIASHGVHMHAPEVALEVLGTAVDKAADARTKLVRLLAKKGITEPVAIPDISTKAAAQKALGMDMEAMKAEKKHFLETVVPEWEEQAKEREARDYEPM

SEQ ID NO: 29445 - protein, 512 aa, Pseudomonas fluorescens
MNAHSDSIDIAIIGSGFAGLCMAIKLKEAGFTDLFVAEQADTLGGTWRDNHYPGCACDVQSHVYSFSFAPNPDWTRQFAPQAEIRAYLEDCAVRFGLAPYLRFGMGLKRAVFDEQLQRWQLSFSDGRHVSARVLVSGMGALARPALPEIPGLETFKGKRFHSQQWDHAYALKGKRVAVIGTGASAIQFVPQIAPQVAHLDLFQRTPPWIMPKPDRGISAFERWLFRHLPVTQRLVRGAFYWALEGRVLGFALHPQLMKMVQKVALRHLRKQVPRPSLRKALTPDYTIGCKRVLISNDYYPALSRSNVEVVTDKILRIEADGVITADGIKHPADCLIFGTGFQATDPLPRDCIIGRDGVDLMDTWRDGAHAYKGTTVPGYPNLFLIIGPNTGLGHNSMILMIEAQVTYILDALRQMQRHRIATVDVKPMVEQAYNRQLQDQLKRTIWNTGGCQSWYLDPRTGKNTTLWPASTWRFKRVTRQFALKDYAVDLLPLTAPPRPATAPHSTAEGSLS

SEQ ID NO: 29446 - protein, 118 aa, Calonectria avesiculata
RSTGGKAPRKQLASKAARKSAPSTGGVKKPHRYKPGTVALREIRRYQKSTELLIRKLPFQRLVREIAQDFKSDLRFQSSAIGALQESVESYLVSLFEDTNLCAIHAKRVTIQSKDIQL

SEQ ID NO: 29447 - protein, 473 aa, Salmonella enterica
MPTHLVWFRRDLRLQDNLALAAACRDASARVLALYISTPAQWQAHDMAPRQAAFISAQLNALQTALAEKGIPLLFHEVADFNASIETVKNVCRQHDVSHLFYNYQYEFNERQRDAAVEKTLPSVICEGFDDSVILAPGAVMTGNHEMYKVFTPFKNAWLKRLKEDIPPCVPAPKIRVSGALSIPLTPVSLNYPQQAFDAALFPVEENAVIAQLRHFCSQGADEYASRRDFPAVDGTSRLSASLATGGLSPRQCLHRLLAEQPQALDGGPGSVWLNELIWREFYRHLMTWYPALCKHQPFIRWTKRVAWQENPHYFQAWQKGETGYPIVDAAMRQLNATGWMHNRLRMITASFLVKDLLIDWWLGERYFMSQLIDGDLAANNGGWQWAASTGTDAAPYFRIFNPTTQGERFDRDGEFIRQWLPALRDIPGKAIHEPWRWAEKAGVVLDYPRPIVEHKQARIATLSAYEAARKGA

SEQ ID NO: 29448 - protein, 319 aa, Oceanobacillus iheyensis
MSKQTEIATFAGGCFWCMVEPFDQRPGVIDIRSGYTGGHVENPTYEQVCTNTTGHVEAVQITFDPEIMPYKELVETFWQQIDPTDAGGQFNDRGESYQTAIFYHTEEQKKIAEDSKKALDESNRFKMPIVTPVLPAKPFYEAEEGHQDYYKKRSFHYRMYKKGSGRQDFIKNNWQNTIDKNELKEKLTPIQYHVTQENGTERPFDNEYWNNTQEGIYVDIIKGNVLFSSKEQYDAGCGWPSFTKPVDPYQIEDKVDKTHGMVRTEIRSKQSDSHLGHVFEDGPQDKGGLRYCMNSAAMRFIPKEKMEEEGYSKYLYLFN

SEQ ID NO: 29449 - protein, 321 aa, Vibrio fischeri
MSNVKHSKLLILGSGPAGYTAAVYAARANLNPVMITGMQQGGQLTTTTEVENWPGGAADMTGPGLMEEMKAHAERFNTEIIFDHINETDFSQRPFRLKGDSGEYTCDALIISTGASAKYLGLESEEAFKGRGVSACATCDGFFYRNQKVAVVGGGNTAVEEALYLSNIAAEVHLIHRRDSFRSEKILIDRLMDKVENGNIILHTDRTLEEVLGDDMGVTGVRLKDTKSDATEDLEVMGAFIAIGHQPNTAIFNGQLDMENGYIKVKSGLEGNATQTSVEGIFAAGDVMDHNYRQAITSAGTGCMAALDAERFLDALEAKES

SEQ ID NO: 29450 - protein, 589 aa, Pseudomonas chlororaphis
YLDNNIKLLLNRKVVEIDRVKRRVIAEDGSEAEYDRLLIATGSTPFILPIPGNTLDGVIGYRDIADTQAMINTAKTHKHAVVIGGGLLGLEAANGLKLRGMDVTVVHLGEWLLERQLDKTSGQLLQTALENRGLKFRLSEQTQALHDAGNGRVGSVQFKNGDIIPADLVVMAAGIRPNTELAEKSGIPCNRGILVNDTMQTYDPRIYAIGECASHRGTAYGLVAPLFEQAKVCANHLAQLGFATYKGSVTSTKLKVTGIDLFSAGDFMGGEGTETITLSDPIGGVYKKLVIKDDVLVGACLYGDTADGGWYFRQIRENHAISEIRDHLMFGENALGDVGHQGQDKAMSMADSAEVCGCNGVCKGTIVKAIQEHGLFSVDDVKKHTKAASSCGSCAGLVEQILINTVGGAADVKPKSEKAICGCSDLNHGQIRQAIRDQHLLTIAGTMSYLNWRTPNGCATCRPALNYYLISTWPGEAQDDPQSRLINERAHANIQKDGTYSVVPRMWGGVTNPAELRRIADVADKYNVPMVKVTGGQRIDLLGIKKQDLPGVWKDLDMPSGHAYGKSIRTVKTCVGSEFCRFGTQNSTQ

SEQ ID NO: 29451 - protein, 117 aa, Zea mays
PAVPGLLAPKIKRLPPPALLTQGTRSPWPPHRPPPPCCARRPWPGSAWRRLPAGRAQNGKTHFDAGDERAKEFAALLKSNDPVGFNLVDVLAWGSLGHIVAYYILATSSNGYDPNFF

SEQ ID NO: 29452 - protein, 186 aa, Zea mays
  misc_feature (93)..(93): Xaa can be any naturally occurring amino acid
  misc_feature (157)..(157): Xaa can be any naturally occurring amino acid
ARRTAICYRSIKSQTYPKTRYCRGGPDPRTTIYDVGMKTQCVANFLYCVHLVSWNKENVSSEALEAALIGCNEYMTKSVRNYVLMLRVPDHPXHVLAIINMLILAIIHRLPTAMTCAFAKTQVSCANLDIVPALLSPLCKDNNDAHGSEALTLGKFXFPGRQKIIESIKWGFTKISRADYLNYKSE

SEQ ID NO: 29453 - protein, 159 aa, Plantago major
MLQRIGIGLVLSLVSIVYAAIIERKRLATAMEYGLVDMPKAVVPMSALWLAPQYVLSGVADVFTMIGLQEFFYDQIPCDLKSIGLAMYLSILGIGSLLSSFLVSFIQNMTKGHGQDGWFADNLNKAHLDYFYWLLAGLSTVGLSAYIYFARSYVYRRKV

SEQ ID NO: 29454 - protein, 269 aa, Ralstonia solanacearum
MEAKTIPTTKGRVSLIGAGPGAADLITVRGARLLGEAEVVLHDALVSPEVFQYCPQAVLIPVGKRCGKRSTAQRFINRQLVDLATKYQRVVRLKGGDPMLFGRADEELQALEAAGIEYEVVPGITAALAAASAIRQPLTKRGVARSVAFVTQAKAADPDTPAPEGAAPEPAVQADSLVYYMGRDQAASIAADLIARGRAPSTPAWVVEAATMPQQRSACFTLQQMAEGAAAAWIHPEHPSLLMIGEAFAGRAASAAPAQCPGAPHVLAA

SEQ ID NO: 29455 - protein, 248 aa, Pseudomonas fluorescens
MTVYFIGAGPGDPELITVKGQRLIHRCPVIIYAGSLVPQAVLDGHRAERVINSAELHLEQIIEAIKQAHARGQDVARVHSGDPSLYGAIGEQIRCLRELDIPFEIIPGVTATAACAALLGAELTLPDVSQSVILTRYADKTAMPVGEDFASLAAHGATMAIHLGVNHLSKIVAELLPHYGADCPIAVVHRATWPDQDWALGTLADIVDQVAAKGFRRTALILVGRVLATDAFSESSLYRAGHAHLYRP

SEQ ID NO: 29456 - protein, 450 aa, Robiginitalea biformata
MADYKDKIDAFMEEVTSRNGHEPEFIQAVQEVAETVIPYIAEQEIYSGKNILLRMVEPERLISFRVAWVDDDGEIHVNRGYRIQMNSAIGPYKGGLRFHPSVNASILKFLAFEQVFKNSLTTLPMGGGKGGSDFDPKGKSDDEVMRFCHAFMTELCRHIGPNTDVPAGDIGVGAREIGFLFGMYKKIRNEFTGVLTGKGLSWGGSKIRPEATGYGTVYFAQNMLETRNDSIEGKTVAVSGSGNVAQYAAEKVLQLGGKVVTLSDSGGHIHDPDGIDAEKLAWVMDLKNNRRGRISEYVKQYPGASYHKGKAPWHVACQVALPCATQNELNGEDAKTLIKNGCICVAEGANMPSTPEAIHAFHDARILFAPGKASNAGGVATSGLEMSQNSLRISWTREEVDQRLKGIMSDIHDSCIEYGREDDGYCNYVKGANIAGFVKVADAMLAQGVI

SEQ ID NO: 29457 - protein, 239 aa, Ceratopteris richardii
  misc_feature (15)..(15): Xaa can be any naturally occurring amino acid
  misc_feature (63)..(63): Xaa can be any naturally occurring amino acid
HGKREPVGIQGAPLXLFLAHQCGPASAVGNGRKRGSTMLERGADCSSFSESFDHDRTGDDGFXRGSEEEAQGRRLVVRKKLRLSKEESALLEEKFEEHSTLTPKQKNALAKQLNLQPRQVEVWFQNRRARTKLKQTEVDCELLRKCCASLTEENRRLQMEVDQLRALSTTQLHFSDFVVANTGLFLDAPLAICPQCQRHFCWICKQRQSSITTSNSCLHQAPARFNSLFSQPQPSFSQN

SEQ ID NO: 29458 - protein, 307 aa, Oryza sativa
MKQTLDVHRSLRPPMPMAQQQMDEFWRDRQKEIEMTKDFSEHMIPMARLKKIVSSQKGNMMMTFDMPAFLSKMCELFVQELAARAWACAQSHNRCIILDMDIAEAVASTESYDFLVDILHNHSVKQKSTPCSSTKRCRLVDQPSTSHIPHQHLLPQFAPTYTLAIPITPSLMPLISQCTPSSFPSLPQEKFPLMAPTPIVNRSMLFINNIGGQEEQHEKETNVEWHHQNEIYESIDIRIINATTRDGNKCSISWDELGMADDSLLDNFLEELQVRKDDVSDTRIAFNKDPFLDDAVLSNPSTSNGNK

SEQ ID NO: 29459 - protein, 130 aa, Brassica napus
  misc_feature (72)..(72): Xaa can be any naturally occurring amino acid
METPKFSQKPCPDRILNNIGGAFEMEPVEGGPFNLIKGTSNSPKGSRLMEGRQAGTINALGWEGSFVVWGGXFSTLDGSMGYLRQKEDPWNSIFAGPATGGFLAIRQGPSSVGRFALFGGGWLALIEGPG

SEQ ID NO: 29460 - protein, 135 aa, Salmonella enterica
MRLLHTMLRVGDLQRSIAFYTNVLGMKLLRTSENPEYKYSLAFVGYGPETEEAVIELTYNWGVESYDMGNAYGHIALSVDNAAEACERIRQNGGNVTREAGPVKGGSTIIAFVEDPDGYKIELIEAKDAGRGLGN

SEQ ID NO: 29461 - protein, 340 aa, Unknown
  Candidatus Kuenenia stuttgartiensis
MEKPADKSEKKAPASQFEKTWVSTFPRVCEGCSQLTNKQFFLINPVLKITTIGTFIKNANAKFVLSKIIVEDFYEGEIYLLLSLKLAITIGNILLLLEDEAIKENANKENFDADCADGFKEFSNQVCGILDNDLRLKLPKPIHLKLLSVEPINKENMTTVLKDDILNEECLFLSTSLRIMGFDDDQFIICVPKLIGEEFFGEIIEEENKEYRGTILAVDDSNTDLRIIRKLLGNDYKVLVTDNPGHALSTLGKTNIDLVLMDIYMPGVDGITLCERIKRNAMVEDVPIIICSAHPTQENVIRAVRAGAADFIVKPVTRQKLMEKINKHMLNKSLKIPANR

SEQ ID NO: 29462 - protein, 214 aa, Ceratopteris richardii
SKAYTQRERLSTTESFPLSMKRDREKMDFETNTSNFNITNNLCEVSSRASDEEDGASTRKKLRLTKEQSAFLEESFKEHSTFNPKQKSALAKQLNFRPRQVEVWFQNRRARTKLKQTEVDCELLKRCCESLTEENRRLQKEVQELRALKMGAPCVVAHDFYMPLPAATLAMCPSCERLSTLDPSSRPPPKQHMSSAPLVSLAFNSHHPQPSAAC

SEQ ID NO: 29463 - protein, 560 aa, Saccharophagus degradans
MIESFAELFEESLKTVDMVPGSIVTGVVIDIDQDWVTVHAGLKSEGVIPAEQFYNDKGELELSIGDEVQVALESVEDGFGETRLSREKAKRAESWKVLEAAHDAEEVITGVINGKVKGGFTVDVAGIRAFLPGSLVDVRPVRETTHLEGKELEFKVIKLDQRRNNVVVSRRAVMEQANSEEREELLANLQEGMAVKGIVKNLTDYGAFVDLGGVDGLLHITDMAWKRIKHPSEIVAVGDEIDVKVLKFDRERNRVSLGLKQLGEDPWSAITQRYPEGAKVKARITNLTDYGCFAEIEEGVEGLVHVSEMDWTNKNIHPSKVVSLGDEVEVMILDIDEERRRISLGIKQCQENPWDAFSNQFAKGDKISGKIKSITDFGIFIGLDGGIDGLVHLSDISWNEAGEEAVRKFKKGDEIETVVLAIDPERERISLGVKQLDEDPFSAYVAENDKGTIVTGTVKEVDAKEAVILLADDITGTLKASEISRDKVEDARNVLKEGDEVEAKITNVDRKNRAIILSVKAKDVADEKAAIKEHSTKAAEAAQPATIGDLIKAEMENKNS

SEQ ID NO: 29464 - protein, 162 aa, Medicago sativa
MQIQIAKQKQKNKKRNMGFTEKQEALVNSSFESFKQNPGYSVLFYTIILEKAPAAKGMFSFLKDSAGVQDSPKLQAHAGKVFGMVRDSAAQLRATGGVVLGDATLGAIHIQNGVVDPHFVVVKEALLKTIKESSGDKWSEELSTAWEVAYDALATAIKKAMS

SEQ ID NO: 29465 - protein, 482 aa, Triticum aestivum
  misc_feature (72)..(72): Xaa can be any naturally occurring amino acid
  misc_feature (89)..(89): Xaa can be any naturally occurring amino acid
  misc_feature (108)..(108): Xaa can be any naturally occurring amino acid
MGMEKGKADPAAFSIAEAGFGDRTDIDDDGRERRTGTLVTASAHIITAVIGSGVLSLAWAIAQLGWVIGPAXVLVAFSVITWFCSSLLXADCYRSPDPVHGKRNYTYXGQAVRANLGVSKYRLCSLAQYVNLVGVTIGYTITTAISMGAIGRSNCFHRNGHNAACEASNTTNMIIFAAIQILLSQLPNFHKIWWLSIVAAVMSLAYSSIGLGLSIAKIAGGVHAKTTLTGAAVGVDVTAAEKVWKTFQSLGDIAFAYTYSNVLIEIQDTLRSSPPENVVMKKASFIGVSTTTAFYMLCGVLGYAAFGSDAPGNFLTGFGFYDPFWLIDVGNVCIAVHLVGAYQVFCQPIYQFVEAWARGRWPDCAFLHAELAVAGSSSFTASPFRLVWRTAYVVLTALVATVFPFFNDFLGLIGAVSFWPLTVYFPIQMYMAQAKTRRFSPAWTWMNVLSYACLFVSLLAAAGSVQGLVKDLKGYKPLFKVS

SEQ ID NO: 29466 - protein, 318 aa, Plantago major
MATFPVVNMENLNGDERSSTMDIIKDACENWGFFELVNHGIAPEFMDTVEKLTKDHYRRSMEQRFNEMVANKGLEAVQSEIEDLDWESTFFLRHLPVSNISEIPDLQDEYRKVMKEFASQLEKLAEVLLDLLCENLGLEKGYLKKAFYGSKGPTFGTKVSNYPPCPKPDLIKGLRAHTDAGGIILLFQDDKVSGLQLLKDGEWVDVPPMRHSIVINIGDQLEVITNGKYKSVMHRVLAQTDGSGRMSLASFYNPGSDAVIYPAPALVEKEDSKDLYPKFVFEDYMKLYSGVKFQAKEPRFEAFKAMESNATVGPIATA

SEQ ID NO: 29467 - protein, 148 aa, Brassica napus
STQASTLRFSVTFPALLSLLLLSLWVVEAYTSRKLISNNEQEGQNISHLFKDGEFEDPTMYMFFKISDLKLGTKLPIYFNKNDLRKVPPLLTRQEADLIPFTIEGEYKFCGTSLESMLDLAKKTIASNADLKVMTTKVMVPDHNRISY

SEQ ID NO: 29468 - protein, 649 aa, Bradyrhizobium japonicum
MFGLPLRCRAGLSALVVLTSQLVANAALASDFGLGRAHPTGQVAQGWELAQAEDDHAAHHPAASGSAGGAAGAPPGGATPGMMGGMDGMMGRPRKEFYPALMEMPSLSAEQRSNLEIQARERISAETDRLAGAEMDLRHAIAGSDIVAADQAARRLRESLNAVQSGVVALRSLHEGKPPQQIAQAWFKSQMNLLPQRGAMDADDGTPGVSWFHVTTMALLVLFSLAMLAVYLARMRRANALVDRLTRAAVAPAAAAPLVSPPAAGVPNDKPEATSSQETDRHPRRVEASRSWKGKLRICAIYQETPNVKTFRLQAPDGGAIPFAFLPGQFLTYAIEIDGQAVRRSYTIASSAAQTAYVETTIKREDGGLLSDYMHGHLKEGDLVEVAGPSGAFTFTGVEADSVVLIGGGVGITPLMAAIRYLSDIAWPGQIYLVYGAQTTEQFIFRDELEYLQRRMSNLHVAATMVRAAGTSWMGSEGQITAEFLTQAVPDLARRRVHLCGPPGMMDALRKTLIGLGVPREQIKTEAFGPARGAVPPPGKVAAEAQMPAAEASNRGAATVGPATATIRFATSDKVVALPPDKSVLEVAESAGVSIDYSCRVGVCGVCKTHLLQGNVTMEVQDALTADDKANGLILACQARSVGDLVVEA

SEQ ID NO: 29469 - protein, 250 aa, Triticum aestivum
  misc_feature (134)..(134): Xaa can be any naturally occurring amino acid
  misc_feature (213)..(213): Xaa can be any naturally occurring amino acid
AYLGDTTEQVCTKKQAGTGPEFPGYRRPTRPLAQNLAGEIIGTRFEDADIKSTPLPPYAEVFGLQRFRECELIHGRWVMLATLGALTVEWLTGVTWQDAGKVELVDGSSYLGQPLPFTLTTLIWIEVLVIGYIXFQRNAELDPERRLYPGGSYFYPLGLAADPVKKETLQLAEIKHARLAMVAFLGFAVQAAATGKVPLIHWATHLSYPLHTXIFDTFGSSEVVGGRAFLAAQLQNGRTRVSVRTCFGFV

SEQ ID NO: 29470 - protein, 477 aa, Triticum aestivum
MPELLRTLTAGRRRLLLVLQLVPGLLLLLLSRLTSASASTVVTHLPGFDGPLPFYLETGYVGVEEETGAELFYYFAESERSPGTDPVILWLTGGPRCSGFSGFAFEVGPVKYVLAPYTGGLPQLVHNPLSWTKMASIIFLDSPVCSGFSHARDPKGCDVGDYSSSLQVQRFLNKWFTDHPQYHANPFYLGGDSYAGKVIPLIAHYMLQGTEKREQPLINLKGYLIGNPVTDPKFDKNFQVQGAHGFGIISDQIYEAAVKNCKGNYVNPANQLCAEVLETVDSLISEIADAHVLYKKCVVATPKPIDDAIRRKFLLEESIEPNEAPGRPTIDCFTYGYYLAYFWMNNRMTRDALGIKGGTVGEWVRCKKELPYTQDMPSSIPYHLNLTTRGYRALVYSGDHDLQVPQLSTQAWIRSLNFSIGDDWRAWHLDGQAAGFTITYANNLTFATVKGGGHTAPEYQPEECFAMAQRWLDNKPL

SEQ ID NO: 29471 - protein, 377 aa, Methylococcus capsulatus
MAKEDYYETLGVPRNASDSDIKKAFRRLAMKYHPDRNKDNPEAEERFKSVKEAYDVLSDPKKRSAYDQFGHAGIDPSMGGGGGFGFTGDSFSDIFGDVFGDIFGGGGRRRGRGQRGSDLRYNLELTLEEAVAGTEAKIKVPTWVTCTECGGSGAKKGSAPVTCPTCHGQGAVRMQQGFFSVQQTCPTCRGTGQHISDPCRVCYGQGRVQETKTLSVKIPPGVDTGDRIRLSGEGEAGEGGGPPGDLYVHIGVKQHPIFTRDGADLYCEVPIGFPTACLGGELEVPTLDGKVVLKIPAETQTGRLFRVRGKGVKPVRGGVAGDLLCRVRVETPVHLNKEQIDLIRQLDESLRGGGSHHSPQAHGWLDGVKQFFDRLGL

SEQ ID NO: 29472 - protein, 258 aa, Xylella fastidiosa
MTQSRWRLDGRTALITGASTGIGLAVARELLGLGADVLLVARDADLLGRVRDELAEEFPERELHGLAADVADDVDRRAILDWVEDCSNGLHVLINNAGGNVTRAALEYTEDEWREIFEINLFSAFELCRYTQPLLACHASTAIVNIGSVSGLTHVRSGVPYGMSKAALHQMTRNLAVEWAEDGIRVNAVAPWYIRTRRTSEPLSDVCYYEQVIERTPMRRIGEPEEVAAAVAFLCLPASSYVTGECIAVDGGFMRYGF

SEQ ID NO: 29473 - protein, 1126 aa, Candida albicans
MVLNDFDLKTEALNERTTLHTSQNASSKNGSNKESVLAKYEETNQNDEIEGFENLNDLSFSKYSKFSKASIIVGSDPKSRTTTLDSPFAKKLKEDLNVEFTSDNTKPYYPTVYPIYEFDNNDENSDSPFLDYQNEKGNIPQKLSGQKLRKQQQQQQQQSEAEENFKQSNQYARLQSTPKHQRTSSVKVSLTPAQKFEKRTSTRSHNALDNFELTTLVGNGAFASVYRAVNLKTNQVIAIKQIRIEKDQDVGVLMGEIDLLKILKHRNIVKYHGFVKTATSLNVLLEYCEGGSLRQLYKKLKKGLPEYQIINYVRQILEGLNYLHEQGVVHRDVKAANVLLTDKGDVKLADFGVATKVTSQHLTVVGTPNWMAPETVLGGEGICTASDIWSLGATIIELFTTNPPYHDLNAMATLHAIGTDEHPPLPKNMSTLAKDFLLECFQKQANLRISAKLLLKHKWLNQTATAKTSMATLLRQPSRELRSIKIYSESNDENWDEDFEEIKVSKFQNSTSSIIELKPDNTEKQFKLTEYSKKDLLTLFADNKEDTSNNFEFETIGPNKLAVVAESMDESDPFLNIDIENFDTNELEVQSKMEYLVVRLSRKLEQVHLGYEDAVPALVKVTGRMLHLVKKYPVSHDTLIRDHGVLSLLELLESFQDIPSQQQLWYHCLSILNHVFESDLGTLENFCFLGGIPTVAHFRSATYEVQVRLQVAKFIGILNLSEKALSMFVSCGGLRLVSKFVEEDFDTTPTFPLIAIESIHNILAKDLSRSKSDLCRILSKHGVIFWLVVLLNRLVKYDQKPSIKNVSKEQVEITIERIIDIIKYFSQSETKVRISIGSIDLFKLIFKLFDNLKLSHQLTLLKFVKSMSCISEVLKNLYHAEILEFLVKLLKSYIPSKGNYKEIINVLAPILYNSLALNHRRESEFVNLGGLPYLKTLSIINLPFRQFILPIICEFVHCDASVVNELKKNDIVKIYYNLLLDPYWQSNALDSLHCWYKLEPSYIDLNSPMAVDCLVGGFLLPKVSNLESTLEIYFKLLTNNLPLTRDMSNMNVINSILIKLSLHDKKNPVIQLSYLKVLKCLINYLVDSKSSLPFAKPVVNTLQSLKSRQSSLLIEEVTTELLSVLK

SEQ ID NO: 29474 - protein, 257 aa, Oryza sativa
MLRPAAAAAGRAIRRAAYHSDGAPPPRKLRGPRFSPLNRHNHEAGQWGEAGEEVGAVAAAGVGGGCDGGEWRASASAAAATWEKGRASPHGRGGAEVVHGGERAGARPPVEEDLPRRRWCMPSAASDDATLGRHLACRLVQVGISDVFAVPGDLNLTLLDHLIAEPGLRVVDCCNELNTGYAANGYAWARGMGTCTVTFTVCGLLLHGRRHRSHWFWNQETGDEAGAAFRNQERASASPSLPSAVARRSGSVVVGGG

SEQ ID NO: 29475 - protein, 695 aa, Chlamydia trachomatis
MAFETFSVALDKDKTLIFETGKIARQASGAVLVKMNETWVFSSACAASLSEAVDFLPFRVDYQEKFSSAGRTSGGFLKREGRPSEREILVSRLMDRSLRPSFPNRLMQDIQVLSYVWSYDGKTLPDPLAICGASAALAISEVPQNCIVAGVRVGLVGGKWVINPTRDELSASKLDLVMAGTASAVLMIEGHCDFLTEEQVLEAIAFGQTYIAKICDAIEAWQKAIGKQKNFSAVLDMPEDVQNVVSDFIREKFEKALSFRDKEALEQASKELEESVIANLVQEENSDFSLLNVKAAFKTAKSNQMRALIQDLGIRVDGRTTTEIRPISIETPFLPRTHGSCLFTRGETQSMAVCTLGGENMAQRFEDLNGDGAARFYLQYFFPPFSVGEVGRIGSPGRREIGHGKLAEKALSHVLPETSRFPYIIRLESNITESNGSSSMASVCGGCLALMDAGVPIKAPVAGIAMGLILDRDQAIILSDISGIEDHLGDMDFKVAGTAKGITAFQMDIKIEGITHKIMEQALAQAKQGRSHILNLMTQVLASPKGTVSKYAPRIETMQINTSKIATVIGPGGKQIRQIIERSGAQVDINDDGVINIAASTQESINKAKELIEGLTGEVEVGKVYNGRVTSIATFGVFVEVLPGKEGLCHISELSKQKVDNISDFVKEGDKLAVKLLSINEKGQLKLSHKATLED

SEQ ID NO: 29476 - protein, 612 aa, Bradyrhizobium japonicum
MCGIAGIVNLRGSAVEPDDISRLTGLIAHRGPFGQGTWFSADRSLAFGHRRLAIIDPGEGGYQPMRSADGRHVIVFNGEIYNFLELRRELEAQGVVFRSQSDTEVILAAWQAWREDMLPRFNGMWALAIFDTATGELFLARDRFGIKPLLYAVSPERFIFASEQRALVRSGLIDASVDVEVARRLLLDAFGIEGSERTLFRQVRRLQGGHCMWLRQGKVSVRRWWRTVDHLPPVPGTEAEQVARFRELFQDAVALRMRSDVPIGTCLSGGFDSSAVICTMAAHEKAGMGPRDSTAWRHAFVATFPGALNDERPMAEEAAAWAEVAPTFLEIGQADALIDLDQILDDLDDVYIALPSAIWLIYRQLRRQDVTVSLDGHGADELMGGYLQQGQALAFRIRNAAEDFASRSALARRSVDVLRMLALKRRGVYFLRGGLRDLPASLPLVAEDDVLPREWGGLNRRLYRMFHSTVLPTILRNFDRLSMAHGVEVRMPFMDWRLVTYTMALPESSKSSEGYTKAVARRAMANLMPESIRTARRKVGFNSPMPEWLNGPLAGWTADLLDRKVPAFAELVDEAALRTTVSRLTASKSWDWEAVGRIWPYLNMKWMLARYA

SEQ ID NO: 29477 - protein, 268 aa, Oenococcus oeni
MAEKSFDNWKKIVVKVGTSTIVQENSQINLPIIGQLVQTLCALRNQNREVVFVTSGAVGVAINQLGFKERPNEIPRQQALAAIGQADLMAIYNQNFSFYHQITGQILLTYDVFDNPKMLENMLNALRELLKMKAIPIINENDVIAVDEMDHQHSFGDNDCLAAMVTKIIDADGLIILSDVDALYDRNPHEFANAKAIKRVGSITKQVINLASGKSNLGKGGMLTKLKAAKYLLKNDKQMLLLPGSEPDGILKALSGQEIGTLFANEYK

SEQ ID NO: 29478 - protein, 296 aa, Euglena gracilis
RSYMEKYAKDEVAYFRDFATAYQRLAELGVPELPVPWDEIRADVAALVAEKGCAPILIRLAWHDAGTYDQQSNTGGPRAVMRFPGGEAEHGSNNGLDIARGLLQPIVDKYSWVSTADLWAFASVVATEVSGGPKIPFRPGRRDAVTAKEAVERGRLPDATQTTNHLRDVFYRMGMTDEEIVALSGAHTMGRCHAERSGFEGPWTDNPLVFDNSYFKLLLERKWTAVTNSVGNLQFQDETGTLMMLTSDLALLMDPSFRKHVERFAADQDAFFRVYAGAYQKLTEGGCPFSKGAVPL

SEQ ID NO: 29479 - protein, 420 aa, Oenococcus oeni
MNTNKLHKQINLIGERAQAASQIVSGLSIDERNKILLSFASEIEKNSDKIVEINVQELKEHRDDLSLPMQKRLQLSKEKISTIASSLKALVKLADPLSEGNTSWQAKAGFKVVKKTVPLGVVAMIYEARPNVTIDAAALTIKSANAVILRGGKESIKTNQVLVSILQQSLKKLGYSENIVQLIEDTSHDSVKELLHLRKFIDVLIPRGSGSFINYVVDNSTVPVIETGAGNDHIFVDKSADQEEAIKVIVNSKIQNPSVCNSAEKLLVHADIAKEFLPKLFDRLSNEGVEIRGDKEVQLIDNRVELAKDFDWDTEYNDLIIAVHLVNNLKEAIDWIGKHTTHHTEAILTNSAENASEFMQRIDAAVVTENASTRFTDGFEFGFGAEIGISTQKLHARGPMGLTALTSYKYEIFGHGEIRK

SEQ ID NO: 29480 - protein, 219 aa, Methanosarcina barkeri
MKDNLPEKGAIVQRDRETYAIAPHIPGGIADPNTLRKIADVAEKYGAAALKMTSAQRIAIVGLKEEDLDNAWADLDMKPGAAVGLCVRSVKFCPGTTFCKQGKQDAVGLGLKLDEKYHGMSMPSKFKMAVSGCPNSCSEPAIKDIGVMGTAKGYTLMVGGAAAASPRLAEVVAKNLSEEEVLDAIDRIVNFYKNSGTKKRLGKFIDGVGLEEFKAQVGL

SEQ ID NO: 29481 - protein, 508 aa, Schizosaccharomyces pombe
PTHNQTFINHTTKRRIMSQKEVADFGLIGLAVMGQNLILNGADKGFTVCCYNRTTSRVDEFLANEAKGKSIVGAHSLEEFVSKLKKPRVCILLVKAGKPVDYLIEGLAPLLEKGDIIVDGGNSHYPDTTRRCEELAKKGILFVGSGVSGGEEGARYGPSLMPGGNPAAWPRIKPIFQTLAAKAGNNEPCCDWVGEQGAGHYVKMVHNGIEYGDMQLICETYDIMKRGLGMSCDESTDVFEKWNTGKLDSFLIEITRDVLRYKADDGKPLVEKILDAAGQKGTGKWTAQNALEMGTPVSLITEAVFARCLSSLKSERVRASKKLTGPNTKFTGDKKQLIDDLEDALYASKIISYAQGFMLMREAAKEYGWKLNNAGIALMWRGGCIIRSVFLKDITEAFREDPNLESILFHPFFTNGVEKAQAGWRRVVAQAAMLGIPVPATSTGLSFYDGYRSAVLPANLLQAQRDYFGAHTFRVLPEAADKSLPADKDIHINWTGHGGNISATTYDA

SEQ ID NO: 29482 - protein, 224 aa, Xanthomonas oryzae
MFRVSWRPVRTALPMPSRSKSSQRWLKEHFADPYVKKARAEGMRSRAAYKLEELLQRDRLLKPGMVVVDLGAAPGGWSQQVRKSMGDSGRVVALDILDMPALAGVEFLHGDFREQAVLSQFEAMLGDVPVDLVLSDMAPNKSGMDAVDQPRMMHLAELAMEFADAHLKPGGAFLIKLFQGVGSDDYIRELRRRYEKVTIRKPAASRKRSPEVYALGQGKRVQIK

SEQ ID NO: 29483 - protein, 302 aa, Pseudomonas chlororaphis
MPAQGRPAVPRFGLRQARGLPAAQLADRPGNRPGPGPGRGLRPSPFGPGRKRPGAAGPAGRKLMDRQITASTCCYCGVGCGVLIEHDGERILGVSGDPAHPANFGKLCSKGSTLHLTGDLAARALYPELRLGKGLARARSDWDSALDHAASVFAETIAEHGPDSVAFYISGQLLTEDYYAFNKLARALVGTNNIDSNSRLCMSSAVVGYKRSLGADAPPCSYEDLELSDCVMIVGSNMAYAHPILFRRLEEAKSRRPQMKIIVIDPRRTDTCDLADLHLAILPGTDVALFHGILHLLLWEDW

SEQ ID NO: 29484 - protein, 227 aa, Coprinopsis cinerea
MVSLAAQQPHQRAFNPYTENGGTILAVAGADFTVIAGDTRQSEGYNIQTRYAPKVFKLTDKAVLAVNGFAADGNMFVKKVKQRLEWYRHAHAKDMPIRSIARLIQTMLYARRFFPYYVYNILGGIEEDGTGAVYSFDPIYFKNQTPAPGTSFPQHLPLQTVLALVIDSFTGATERHIEVGDGLEMYVVLSQNSSALQSLQNVRGVQEVTATNDGERVFVIRRDLKKD

SEQ ID NO: 29485 - protein, 314 aa, Glycine max
  misc_feature (292)..(292): Xaa can be any naturally occurring amino acid
MELLQNGHKNLVSIKPSELPLLNGAALTLLNSLSETHEYYGNIDPSRVFVTKVKRIIVKVGTAVVTRSDGRLALGRIGALCEQLKELSSQGYEVILVTSGAVGLGRQRLRYRKLANSSFSDLQKPQGELDGKACAAVGQSSLMALYDTMFSQLDVTSSQLLVNDGFFRDSGSRIQLSDTVNSLLDLRVIPIFNENDAVSTRKAPYEDSSGIFWDNDSLAGLLALELKADLLVLLSDVEGLYSGPPSDPNSRLIHTYIKEKHQGEITFGDKSRLGRGGMTAKVNAAVCAAHAXIPVIITSGYATNNIIRVLQGER

SEQ ID NO: 29486 - protein, 74 aa, Chlorokybus atmophyticus
MEKQNIIEMEGVITESLPNAMFRVHLDNGFDVLAHISGKIRRNYIRILPGDRVKIEMTPYDLTKGRITYRLRKR

SEQ ID NO: 29487 - protein, 413 aa, Pseudoalteromonas tunicata
MLEQLAQDAQIASYQLATLSSRSKNQALKAIINQLVQHQSAILAANQLDIAAGKEAGLTDALLDRLLLTAERLAGMCQDIEQLIALSDPIGEEYQGKQLESGLFLKKRTVPLGVIGVIYEARPNVTIDIACLALKTGNAAILRGGKETLNSNILLVKLIQTALVEVGINAQAVQLIADPDRALIYQLLKLDKYIDMIIPRGGQTLQQVCVEHSTIPVITGGIGICHLFVDESADVEKAIAVIRNAKVQRPSVCNALDTVLIHQSIAYEFINRLVPALAADGVSFRGCPQSVAINATCQVAQASDFDTEWLSLTLGIKVVDDLSKAVSHIRAHSSGHSDGILTQSLKSADQFVAQVNSAAVYVNASTRFTDGAQFGLGAEVAVSTQKLHARGPMGLDALTTYKWIGIGDGLIRS

SEQ ID NO: 29488 - protein, 452 aa, Novosphingobium aromaticivorans
MRYLPLTDADRSAMLSVVGAGSVDELFADVPAEARLSAPIAGLPNHASEMAVERHMARLSANNVTAGSVPFFLGAGAYRHHVPATVDHMIQRGEFLTAYTPYQPEIAQGTLQVLFEFQTQVARLFGTDVANASLYDGSTACWEAIAMAGRITKRGKALLSGGLHPHYVETARTMARFTGDVLDTSAPVLTAAPDDDALVARIDGETSCVVVQYPDILGRIPDLAKIAAAAQAQGALLITVVTEPVALGVLQSPGSLGADIVVGEGQSLGVGLQFGGPYLGLFGCREKYLRQIPGRLCGETVDADGKRGFVLTLSTREQHIRREKATSNICTNSGLCALAFSIHLTLLGGSGLADMARLSHLAARKTAAALAQVSGIEVVNSHFFNEFTVALPHDARQIVRDLADRHVLGGVSLGRLYPQEAALANGMVVAATECTTDEDIAALVAALKEVLA

SEQ ID NO: 29489 - protein, 262 aa, Nostoc punctiforme
MSDAYGGLSLRWTLRGKKALITGATKGIGLAVANEFLSLGAEVIIVARNSQDVDQQLIIWRELGLPAYGITADVATAEGRQAIFEQVGKTWDKLDILVNNVGTNISKKVLDYTAAEYQFIIQTNQISIFEMCRLFYPLLQNRENSSIVNISSVAGLVSNRTGAPYGMTKAAINQLTRSLSVEWACDQIRVNTVAPWAIRTPLTESVLDNQDFLKLVLSQTPMGRVGQPEEVAGLVAFLCMPAASFITGQCITVDGGFLAFGF

SEQ ID NO: 29490 - protein, 175 aa, Zea mays
KRSEAMSMSKTGQAAEKDEQQQSRGIALMQGICAVVYRKADNTPCPIKQGLYLGSVGAAFNKDALKSLNITHILIVAKSLDPVFPAEFNYKKIEDEAISSGGNVLVHCFAGRSRSVTIVVAYLMKKHQMSLESALSLVRSKRPQVAPNGGFISQLEKFQKSLQVEQEWRMQPVQH

SEQ ID NO: 29491 - protein, 420 aa, Arabidopsis thaliana
MAAPEAPVKYVGICKDSAAFKLMKSMGWEEGEGLGKDKQGIKGYVRVTNKQDTSGVGLDKPNPWAFDTTQFDNILKKLKVVMAVKLLLPRLARMMMLIYPNDCCFMWHTIDSDKEDESEDDAVKSEPAKLKTVAKVTRPQGRYKRREKGKLVNSYSSKDLEGILVKRTEDPSPAVCDIADSMDIEIISEDQDASIKEQKIEEPSSNWWGFKSGFVSGGLLGAKSGKKKLKASERKMFSENDQENLYNMVQVCSLQAVLGKEDKATAGKQGLGIKDRPKKIAGVRYEGKKTSFDNSDDDDDDDDDDDEEDEEEDEDESEADDDDKDSVIESSLPAKRKHDEIIEPKIKLKNLCKQIVKKDAGKGGFMKLKQLKSLIDEQAPSVLSEFSSRKDAIAYLKLKLERSGKFVVEGKKISLVSSKK

SEQ ID NO: 29492 - protein, 195 aa, Deinococcus radiodurans
MPRTAAVTRTTKETDITVRLDLDAAPYEQPATGHGFFDHMLDALARHSRLGISISGTGDLHIEPHHLIEDTGITLGQALSQALGDRKGIERYGSAFVPMDETLAHVVLDLSGRAHLAFEPETLDVYGDAGGMTHYHLREFLRGFCNHAGATLHVRLLAGREAHHVIEAVMKAFARALRDAVAVTSDALPSTKGSL

SEQ ID NO: 29493 - protein, 322 aa, Yersinia pseudotuberculosis
MSKIYEDNSLTIGHTPLVRLNRIGNGRILAKVESRNPSFSVKCRIGANMIWDAEKRGILTAGKELVEPTSGNTGVALAFVAAARGYKLTLTMPETMSIERRKLLKALGANLVLTEGAKGMKGAIAKAEEIQATDPERYLILQQFSNPANPEIHEKTTGPEIWEDTDGDVDVFVSGVGTGGTLTGVSRYIKNTKGKAITTVAVEPTDSPVITQALAGQEIKPGPHKIQGIGAGFIPGNLDLSLVDRVALVTNEEAISMARRLMDEEGILAGISSGAAVAAAVKLSEEEGFTDKTIVVILPSSGERYLSTALFADLFTEQELQQ

SEQ ID NO: 29494 - protein, 471 aa, Chlamydia trachomatis
MNKHKRFLSLVLLTFILLGIWFCPHSDLIDSKAWHLFAIFTTTIIGIIVQPAPMGAIVIMGISLLLVTKTLTLDQALSGFHSPITWLVFLSFSIAKGVIKTGLGERVAYFFVKILGKSPLGLSYGLVLTDFLLAPAIPSLTARAGGILFPVVMGLSESFGSSVEKGTEKLLGSFLIKVAYQSSVITSAMFLTAMAGNPIISALASHSGVTLTWAIWAKTAILPGIISLACMPFVLFKLFPPQITSCEEAVATAKTRLKEMGPLNQGERIILLIFSLLISLWTFGDSIGISATTTTFIGLSLLILTNILDWQKDVLSNTTAWETFFWFGALIMMASFLSAFGFIHFVGDSVIGSVQGLSWKIGFPILFLIYFYSHYLFASNTAHIAAMYPIFLTVSISLGANPMFAALALAFASNLFGGLTHYGSGPAPLYFGSHFVSVQEWWRSGFILSIVNLTIWLGLGSWWWYCLGLIR

SEQ ID NO: 29495 - protein, 474 aa, Methylococcus capsulatus
MDYLPIFLKLRDLPCLIVGGGEVAVRKLGLLLDAGAAVTVIAASAEAVIVELADRGLIRLRTKVFEATDSEGFRLIIAATDDRAVNAAVATAARRHGIPVNVVDCPDLCDFIFPAIIDRSPVLVAVSTGGASPVLARQLRTRIETCIPSRFGTLARLAADLRERVRQAIPEPRARRHFWERTLEGPAAELALQGRAEDAERVLLEAADAAARQERPAWGSVALVGAGPGDPDLLTLRALRLIQEADVIVYDRLVSAEILALARRDARRIYAGKERSRHSIPQDDINALLANLAAEGNRVVRLKGGDPFIFGRGGEEIETLMACGIPFQVVPGITAASGCAAYAGIPLTHRAHAHACVFVAGHLKDGTLQDLDWSQLVQPHQTVVVYMGLQGLPQICAELIRHGAPPSRPAALIQQGTTRDQKVLTATLETLPDKVADAGIKAPTLIIIGEVVGLRKKLAWYRSRQETEGRSGNG

SEQ ID NO: 29496 - protein, 175 aa, Saccharomyces cerevisiae
MGAAPSKIVDGLLEDTNFDRDEIERLRKRFMKLDRDSSGSIDKNEFMSIPGVSSNPLAGRIMEVFDADNSGDVDFQEFITGLSIFSGRGSKDEKLRFAFKIYDIDKDGFISNGELFIVLKIMVGSNLDDEQLQQIVDRTIVENDSDGDGRLSFEEFKNAIETTEVAKSLTLQYDV

SEQ ID NO: 29497 - protein, 210 aa, Methylococcus capsulatus
MAKRSRSSGRWLAEHFSDEYVRLAQEKGYRSRAVFKLMELDEHDRLFAPGTTVIDLGAAPGGWSQYAARRVGASGRVLALDMLPMEPLPGVTVVQGDFLDDAVFHAMLEAIGGRRVDVVLSDMAPNMSGNRNVDQPRSMYLAELAFDLAERVLGPKGSFVVKLFQGEGFQEYVARARKAFGSVGMRKPKASRARSAEIYLVGKGYRGADR

SEQ ID NO: 29498 - protein, 713 aa, Unknown
  Sulfitobacter sp. EE-36
MKPADQLAHEQRRRAEVEALLEQTQAELCAAYRKLDDHAQNVSVEISETRAEVENIRGENKRVMSDLCAAREQIELTQRRLWHSVETIHDGFAFFNKDNEMIMANRSYLAVFDGIDAIRPGVSYSTILRVLTDEGIVNIGRRTPEEWRAKMLLRSQQKAPAPIIIKLWNGAYIKIVDQRGKGGDIVSLARDITETVEYQRKLVDARATAEAANSAKSLFLAKMSHEIRTPMNGIVGMTEVLGDTALTQDQRLYVDTIKTSGEALLVIINDVLDFSRIEANRLSIHPAPFDLERVFQEVLLLLQPLAVQKGLDLALDYDLFLPRKLVGDAGRIRQVLTNLVGNAVKFTQNGHILIRATGLPDAGSGNVLIKILIEDTGIGIAPDMIEHIMGEFTQASSDPSPNAEGTGLGLAICQRLVQLMGGEIWVTSEHGIGSCFGFELPLKAQEDSAAPPLKPPPFLRHVLIVERETICRSILQRNLEHIGVRVTSCGTGSEGLAALDGSIDLLLVDDTLPDMDGIEFARAVHVSDPATQVILYSQTPDKIRDSMDDTSVRRIMKNPISVTELLAEVSTMQPVPVGTRPMRVLAAEDNKTNRLVLRKMLQRLNIDLQLATNGQEAVALFETFRPDLVFMDISMPKMNGKDAAAAIRALEDGASSCPIVALTAHAIQDEKERILAAGLDHFLTKPLRKAELVALLNRYCPNAAFPLEGQLVG

SEQ ID NO: 29499 - protein, 669 aa, Aspergillus nidulans
MYLRAVHAEAQISILQQLIRDNPLGILTTAIKSPLYPLIQSSHIPFVLDAPETSDGSLSNGVLRGHMAKQNPQAKALIEALTAQQEQGNTSLELSDEVLVLFNGPHHHYVTPKFYTETKPATGKVVPTWNYAAAQAYGKIRIYCDSKSEETMTFLQKQIEELSHQSETSIMKYSSPWQVSDAPVSYVELLKKNIIGIEITIDRLQGKFKMSQEMGQGDRDGVISGFENLGTDAGKCIANINTRGGIDIKMASNTNPSPKPKIDLSQKLSELRAARAKTQSPREPAPVTPPLSKPPDLSSHSYSRPVRRILSKNDHETFLSSSTYTLVLAFIFGLSDSVRGRAAPDANAEPGYSPKISKILSVVDNIRTLVESHPSIDQGGSRFGNPAFRDLFDDVAAQSPAWLRDILGIEDAAAVNEISTYLIHSLGSRDRLDYGSGHELNFMMWLLCLRQLGLFSEPDFEAIVFHVYVRYMRLMREVQSTYYLEPAGSHGVWGLDDYHFLPFLFGAAQLVGHPYITPLAIHNTAILDEEGDRYLYLDQVRWVDSVKTVKGLRWHSPMLDDISGAKNWTKIESGMKKMFVKEVLGKLPIMQHFLFGSLLPAEPGMGEGEAEEEGEHTHAHGHSHVHDHSQQLDWFGDCCGIKVPSTVAAGQEMRKRMGGGSSLRPIPFD

SEQ ID NO: 29500 - protein, 475 aa, Kluyveromyces lactis
MPPKEDWEKYKAPIEDEESKEEKKVVPLSEGDIEVLKTYGAAPYAKKLKSIENDLKEIEKKIKEKAGVKESDTGLAPSHLWDIVGDRQRLSEEQPLQVARCTKIIKAEKPQRSGNALGGDADGNGVAAAAAAAAAAAAAASGTEDEDDDDAKYVINLKQIAKFVVGLGERVSPTDIEEGMRVGVDRSKYQIELPLPPRIDPSVTMMTVEEKPDVTYSDVGGCKEQIEKLREVVELPLLSPERFATLGIDPPKGILLYGPPGTGKTLCARAVANRTDATFIRVIGSELVQKYVGEGARMVRELFEMARTKKACIIFFDEVDAIGGARFDDGAGGDNEVQRTMLELITQLDGFDPRGNIKVMFATNRPNTLDPALLRPGRIDRKVEFSLPDLEGRANIFRIHTKSMSVERGIRWELISRLCPNSTGAELRSVCTEAGMFAIRARRKVTTEKDFLKAVEKVINGYKKFSSTSRYMQYN

SEQ ID NO: 29501 - protein, 666 aa, Idiomarina baltica
DIEALMTSDQDWWPADYGHYGPFFIRMAWHGAGTYRVQDGRGGAAGAQQRFEPLNSWPDNVSLDKARRLLWPVKQKYGRNISWADLMVLTGNVALESMGFKTYGFAGGREDAWEPDIVYWGPETEWLGDKRYKGERKLDNPLAAVQMGLIYVNPEGPNGNPDPLLAAKDIRDTFGRMAMNDEETVALIAGGHTFGKAHGAHKPEECLGAEPAAAPVEQQGLGWKNSCGKGNAEDTITSGLEGAWSVNPTAWTTQYLDNLFGFDWEQTRSPAGAIQWIPKDGQAANMVPDAHVEGKRHAPIMFTTDLALKFDPEYRKIAKRFHENPEEFELAFAKAWFKLTHRDMGPKARYLGSMAPKEDLIWQDPIPKVDYTLINESEISELKKQILASKLTVPELVRTAWAAASSFRATDMRGGANGARIALEPQINWEANNPEELRRVLNELKRIRAEFNQSLSGNKQISLADTIVLAGAAAIEKAAEDAGYRVKVPFIPGRADATQEITDVQSFKFLEPTADAFRNYYSEESRLNPAQMMVDKADTLDLTVPELTVLLGGLRSLGANYKGTEHGVFTEQPGTLNNDFFVNLLSMDTQWEPSQDDESLYIGRDRTTGEPKYTATTVDLIFGSNSELRAVAEIYALDDSKDKFVDDFINAWVKVMQLDRFDLEKS

SEQ ID NO: 29502 - protein, 519 aa, Novosphingobium aromaticivorans
MNAINPTGWRPSMGENVPAGGVQTFTGNRALQLEEALIFELGQADRSGVDFPETDGIDLSALGPLARAERPDLPGLSEPEAVRHYTRLSRQNYAIDLGLFPLGSCTMKHNPRLDEKVARMPGFADVHPLQPVQTVQGALGVINELAHWLIELTGMHGVAMTPKAGAHGELCGLLCIRAALEAKGDPRNVILVPESAHGTNPATAAFAGFKVENIPATPDGRVDTAALTARLGPDIAGVMITNPNTCGLFERDLKVIADAVHAAGGYVYCDGANFNAIVGRVRPGDLGVDAMHINLHKTFSTPHGGGGPGSGPVVLSEALSPFGPLPFTARQADGSIRLIEEEHAHEEHPQAFGRMCAFHGQMGMFTRALAYILSHGADGLRQVSGDAVLNANYVLRSLDDVLDAPFGAAGPCMHEALFSDDGFAEGFSTLDLAKGLIDEGYHPMTVYFPLVVHGAMLVEPTETESKAGLDQFIGAMRSLAERARAGDEALKSAPHLAPRRRLDETLAARKPRLVWSSQA

SEQ ID NO: 29503 - protein, 917 aa, Pseudomonas chlororaphis
MLKKLGIKGRVLLLTLLPTSLMALVLGGYFTWMQQSDLQTQLLQRGEMIAEQLAPLVAPALAHQNTALLERIATQSLEQQDVRAVTFLAPDRTPLAHAGPSMLNQAPTGNGSQMLQRTGSDATRYLLPVFGRHRNLAGDLIPDESDRLLGWVELELSHNSMLLRGYRSLFASLMLITAGLICTGLLALRMGRTINNPLSQIKQAVTQLKDGNLETRLPLLGSQELDELASGINRMAGTLQNAQEELQHSIDQATEDVRQNLETIEIQNIELDLARKEALEASRIKSEFLANMSHEIRTPLNGILGFTHLLQKSELTPRQLDYLGTIEKSADSLLGIINEILDFSKIEAGKLVLDSIPFNLRDLLQDTLTILAPAAHAKQLELVSLVYRDTPLSLVGDPLRLKQILTNLVSNAIKFTREGTIVARAMLEEEHEDSVQLRISIQDTGIGLSNQDVRALFQAFSQADNSLSRQPGGTGLGLVISKRLIEQMGGEIGVDSTPGEGSEFWISLRLPKTRDDAEDLPAPPLLGRRVAVLENHELARQALQHQLEDCGLEVTPFNTLEALTNGVTGVHQTEQAIDLAVLGITTNDMPPERLNQHIWDLEHLGCKVLVLCPTTEQTLFHLSVPNPHSQLQAKPACTRKLRRALADLVNPKAVRSEPSEPIASRPPRVLCVDDNPANLLLVQTLLEDMGAKVLAVDSGYAAVKAVQNESFDLVMMDVQMPGMDGRQSTEAIRQWESERNCTPLPVIALTAHAMANEKRALLQSGMDDYLTKPISERQLAQVVLKWTGLALRNQGPERTGEPSGNGLELQVLDHDEGLRLAAGKADLAADMLAMLLASLEADREAIRAARAANDHNALIERVHRLHGATRYCGVPQLRAACQRSETLLKQEDIKAFAALDELERAINRLATEARINA

SEQ ID NO: 29504 - protein, 116 aa, Calonectria clavata
RSTGGKAPRKQLASKAARKSAPSTGGVKKPHRYKPGTVALREIRRYQKSTELLIRKLPFQRLVREIAQDFKSDLRFQSSAIGALQESVESYLVSLFEDTNLCAIHAKRVTIQSKDI

SEQ ID NO: 29505 - protein, 488 aa, Shewanella oneidensis
MGSELLINVTPSEARVALVEHGVLQEVHIERRMKRGLVGNIYKGKISRVLPGMQAAFVDIGLDKAAFLHASDIVPHTECVADVEKGHFVVRDIAELVRQGQDIMVQVVKDPLGTKGARLTTDITLPSRYLVFMPGSSHIGVSQRIEQEEERSRLKKITLPFVDEDGGFIIRTAAEGVGEDELAQDAAFLRRVWSKVSERRQRRGVALLYQDLALPVRIVRDFVGTELDRIQVDSRRTFAELQAFAQEFMPEIADKIEHYSGPAPIFDLYDVENEIQRALGRKVELKSGGYLIIDQTEAMTTVDINTGAFVGHRNLEETIFNTNLEATQAIARQLRLRNLGGIIIIDFIDMLSDEHKTRVLNSLNSALAKDRVKTNVSAFSGLGLVEMTRKRTRESLEHVLCGECPACKGTGSMKTVETVSYEIFREIIRLNRAYDADEFLLYCSPAVYNSLSGDESHLVAELEVYIGKRIRLQNEPMYSQHKYDVVMM

SEQ ID NO: 29506 - protein, 434 aa, Rhodopseudomonas palustris
MGPSVAPHAVHTIANPGVSAAGLVAADHAVAAAIADEETRQRDSIELIASENFVSRAVLDAQGSVLTNKYAEGYPHRRYYGGCANVDAIEDLVIARVNQLFGSAYANVQPHSGSQANQAVFLALLAPGDTILGLDLKAGGHLTHGAPVNMSGRWFKAVSYGVDPETHRIDMDQVAVQARQHRPRLLIAGGSAYPRIIDFGRFRQIADEVGAILMVDMAHFAGLVAGGVYPSPVPFADVVTSTTHKTLRGPRGGFVLTNDANIAKKINSATFPGLQGGPLMHVIAAKAVAFGEALQPEFGAYAQAVVENCRVLAQALADGGLTITSGGTDCHLAVVDLRPFGVTGNIAEQALESVGITLNKNAIPNDPEKPMVTSGIRVGTAAGTSRGFGADQYREIAGLVLETLHAVRAGTLDAAGQEINKSVRRLAASFPLPY

SEQ ID NO: 29507 - protein, 232 aa, Triticum aestivum
  misc_feature (190)..(190): Xaa can be any naturally occurring amino acid
  misc_feature (196)..(196): Xaa can be any naturally occurring amino acid
AYLGDTSEQVLYKKAGCPPVRNSRDIVDPRVRHHRNACIIPVSAHGTNPASAAMCGMKIVAVGTDAKGNINIEELRKAAEANKDNLSALMVTYPSTHGVYEEGIDEICRIIHENGGQVYMDGANMNAQVGLTSPGFIGADVCHLNLHKTFCIPHGGGGPGMGPIGVKKHLAPFLPSHPVIPTGGFPLPEXTDPLGXISAAPWGSALILPISYTYIAMMGSQGLPESFKDCYP

SEQ ID NO: 29508 - protein, 495 aa, Coprinopsis cinerea
MSDLDADLYGDLYGNDETDFNEQNNEEQQQDVTATDAGTKDSEATTTPATETKPASNGTTAQSSTTNGQTSTTTTTKPATSTPIATYTSQQPQLQQIPTYEEPQPVQSISRPDSGALNKIPSGERTVRPSEMKDEGKMFIGGLNWDTTDEGLRDYFSQFGKVDACTIMRDAAGRSRCFAFLTFEDPASVNAVMVREHILDGKIIDPKRAIPRQEHQRATKLFIGGLPGSVTSESMREFFSQFGKVIDSTVMLDRETGRSKGFGFISFEDTDVRPFLGFGNLEIDGKLIDVKLAQPRYQRDNMNNEDGQNQDGYGGGSGGRFNAQGSSGAGAAGNFGGAAGGAMGGAAGGAGGAGAAGGATFDPQALAALYTRMIQMAGGGAMNPAMMGNMAGMNPMMGAMGAGGFAGGMRPGMGMGMNMGMGMGNPAMGGMGRGGPGMMGGAQGGAGGGAGGVPRGPRGGAPGAQGGPPAAGMGNAGVGPQRSQRGTHNFHPYAR

SEQ ID NO: 29509 - protein, 344 aa, Geobacillus kaustophilus
MENIAVLGAGSWGTALALVLADNGHHVRLWGHRTEQISEINEKRTNEKYLPGVRLPDAIIGYDDLCAALDGVAIVVLAVPTKAIRSVLADVRACLAKPITIVAVSKGIEPGTHKRVSEMVAEEMGEWLADVVVLSGPSHAEEVVLRHPTTVAVSSPNMEAARRIQDIFMNHHYFRVYTNPDLIGVEVGGALKNIIALAAGISDGLGYGDNAKAALITRGLAEIARLGCALGANPLTFAGLTGVGDLIVTCTSVHSRNWRAGYMLGQGKKLDEVLESMGMVVEGVRTTKAAYELAKELGVKMPITEALYDVLFAGKDPKEAVDSLMARGKKEEMDDLNNIFAEQE

SEQ ID NO: 29510 - protein, 697 aa, Geobacter sulfurreducens
MTEHKVNVEFGGRTITIATGKWAKQASGAVVVSCGDTVVLVTAVATKSAREGQDFFPLTVNYQEKAYAGGKIPGGFFKREGRPSDNETLTSRFIDRPIRPLFPESFLNDTQIMATVVSADQDNDPGILAMIGASAALEVSDIPFLGPIAGVKVGRVDGQFVCNPTVEQLEKSDLEIVVAASRDAVIMVEGGAAEASEKDVLEAIFFGHAAVQPIIEAQTDLRKLAGVPKREVAATSVDEALKTRVKDLAYAGIKEAVRIVAKQERHNRIGEITAQTLETLLPEYEGRESEIKGFLGDFEYELVREHIIKDGYRIDGRDTTTIRPISIEVSMLPRAHGSALFTRGETQALVASTLGTSIDEQRIDSLYGETRKRFLLHYNFPPFSVGETSFRLAPGRREIGHGMLAERALERVVPKHEDFPYTIRIVSDILESNGSSSMATVCGGALAMMDAGVPIKAPVAGIAMGLIKEGEGIAILSDILGDEDHLGDMDFKVAGTEAGVTAIQMDIKITGVTREIMEKALLQARDGRLHILGKMNQAIAAPRTDLSPYAPRITTIWVKTDKIRDVIGSGGKNIRGITEATGVSIDIEDSGRINIASTSKEACDKAIKMIRDLTAEAEEGKLYMGTVKKVMDFGAFVEIFPGTDGLVHISELDTERVKNVTDVLNEGDKVLVKCIGIDKQGKIKLSRKEALGAVLPE

SEQ ID NO: 29511 - protein, 210 aa, Candida glabrata
MAFVKRVTQETNIQLALDLDGGSVSVRESILGKEYASGDGQTIHVHTGVGFLDHMLTALAKHGGWSLILECIGDLHIDDHHTVEDCGIALGQAFKEALGSVRGIKRFGHGFAPLDEALSRAVVDFSNRPFAVVELGLKRERIGQLSTEMIPHFLESFATEGRITMHVDCLRGTNDHHRSESAFKALAIAIREARTPTGRDDVPSTKGVLA

SEQ ID NO: 29512 - protein, 487 aa, Glycine max
TQQILLFLTKLLSKNSSGDSISTMSNSEHNIITGHAGYVLEDVPHLSDYIPHLTTYPNPLQDNPSYSVVKEHSVDVDDTIAQKAIVHKNSPRETHFRRAGPRQKVYFESEDVYACIVTCGGLCPGVNTVIREIVCGLYHMYGVHKVLGIEGGYRGFYSCNTIPLTPKVVNDIHKRGGTILGTSQGEGGNDTLKIVDSIQDRGINQVYILGGDGTQRGASVIFEEIRRRGLKVSVVGIPESVDNDIPVIDKSFGFDTAVEEAQRAINAAHVEAESTENGIGVVKLMGRHSGFISMYATLASRDVDCCLIPESPFYLEGPGGLFEFIRKRLAENGHMVIVISEGAGHELISESLSATNKQEASGNKLLQDVGLWLSQKIKDHFTKSQKMDITLKYIDPTYMIRAVPSIASDNVHCTLLAQSAVHGAMAGYTGFAVGTVNGKHAYIPFYRINEIEKKVVITDRMWARLLSSTNQPSFLNPKDITTHQTGN

SEQ ID NO: 29513 - protein, 548 aa, Yersinia pseudotuberculosis
MGKTIVIVGGVAGGASAAARLRRLNEYDNIIILERGEYISFANCGLPYYIGGVITERDKLLIQTPEKMKDRFNIDVRTENEVVDIDSASKTITVINHKVGKEEFIQYDTLILSPGARPFIPDIAGLSVNSSVFTLRNMLDTDNIKAYLISATPEAVTIIGGGFIGLEMAENLVSSGLKVTIIELSNQILSPLDYEMAAIVEKHLKDNGVDVIKNDAVVQFDESAHQIHLKSGKIITTDMVILAIGVEPENDLAKKAHLDLGIRGSILVNEKLQTSVADIYAIGDAIQVVDYINGQATYIPLAWPANRQGRLLADIINGRDVRYHGTLGTAIAKVLDLSAACTGNNERLLKRLAIPYQVVHIHGMSHASYYPGAHQISLKLLFSPENGRILGAQAVGQGGTDKRIDVLATAIKGRLTIYDLPDLELAYAPPYSSAKDPVNMLGYVAENISNGDVMTKQWHEVDAFMADGGIIIDVRDEAEFISGSIKTAVNIPLSELRQKLALIPQDKKILVTCQVGLRGYIAARILSQYGYTVANLDGGYLTFNYANA

SEQ ID NO: 29514 - protein, 420 aa, Coccidioides immitis
MARLSPYTKKHKVTVVGSGNWGSSISKMVAENVAANPDLFEPVVNMWVYEEQIEIPKTSRHYNPSSPLCNSLQSLSDVINQLHENVKYLPNITLPDNLRANPSLEDSVKDSSILVFNLPHQFIVGICQKLKGHILPYARGISCIKGVSVTDEGVSLFSEVIGRELGIYCGALSGANIASEIAKGLYSETTIAYDPPHLDSKAPTPQNMSPVSSMVNVNDIVHFQHRDSSGSYSKVKLRPLPAEYPPVDHVFIKTLFHRPYFHVRVVHDVAGVSLGGALKNIVALATGFVDGKGWGDNAKAAIMRVGLLEMVKFGKKFFGETVNPQTFTEESCGVADLITSCNGGRNHRCAKLAVERGLTVEEVEKTELNGQMLQGTLSAREVHAFLKKQGLEDEFPLFTAVYGILEGKVKVDDIPSLIEQ

SEQ ID NO: 29515 - protein, 175 aa, Clostridium histolyticum
MEDKKRNILIGKEEIASKIQEIGAIISKDYEGKNLYVLSLLRGSFIFTADLVRELQVKTKIGFMTTSSYGNSENSSGTVKVVNDVPDNIEGFDVLIVDDIMDTGITMEFVVKHLKELGANSVNTCVLLDKPERRVAKIKPDYTCFEIPDLFVVGYGLNYGDYYRNIPYIFNWENN

SEQ ID NO: 29516 - protein, 220 aa, Ashbya gossypii
MSETQQAFVKRYTPLRPSPNSLALNGGPFEIGQSILGGAKTTVAHQASSSQVINVQTGVGFLDHMIHALAKHSGWSLIVECVGDLHIDDHHTTEDCGLALGQALREAIGQVRGVKRFGTGFAPLDEALSRAVVDLSNRPYAVVDLGLRREKIGDLSTEMIPHFLQSFAESARVTLHVDCLRGTNDHHRSESAFKAVAVALGDALTRTGTDDVPSTKGVLM

SEQ ID NO: 29517 - protein, 49 aa, Arabidopsis thaliana
PLTDWFLSERAPFNFPGFSIMCAGFAMTIAFIQSLMIRAATPISVMGSP

SEQ ID NO: 29518 - protein, 377 aa, Escherichia coli
MSNGIVIIGSGFAARQLVKNIRKQDASIPLTLIAADSMDEYNKPDLSHVISQGQRADDLTRQTAGEFAEQFNLRLFPHTWVTDIDAEAHVVKSQNNQWQYDKLVLATGASAFVPPVPGRELMLTLNSQQEYRACETQLRDARRVLIVGGGLIGSELAMDFCRAGKAVTLIDNAASILASLMPTEVSSRLQHRLTEMGVHLLLKSQLQGLEKTDSGILATLDRQRCIEVDAVIAATGLRPETALARRAGLTINRGVCVDSYLQTSNADIYALGDCAEINGQVLPFLQPIQLSAMVLAKNLLGNNTPLKLPAMLVKIKTPELPLHLAGETQRQDLRWQINTERQGMVARGVDDADQLRAFVVSEDRMKEAFGLLKTLSM

SEQ ID NO: 29519 - protein, 145 aa, Ashbya gossypii
MQALGGNEEPPAETDELDVFHNVGQGLAGRYREIMVQYWQQLINEIESTNEPGSPHRDDFKSHSLPLARIKKVMKTDEDVKMISAEAPILFAKACEIFITELTMRAWCIAEENKRRTLQKQDIAQALQKSDMFDFLIDIVPRGLE

SEQ ID NO: 29520 - protein, 297 aa, Yersinia pseudotuberculosis
MTTLEHCIGHTPLVKLQRLSQGLNAEIWVKLEGNNPAGSVKDRAALAMIQQAELRGDIAPGDVLIEATSGNTGIALAMIAAMKGYHLKLLMPENMSQERQAAMRAYGAELILVSREQGMEGARDLALTMQENGEGNVLDQFNNADNPYAHFTGTGPEIWQQTAGKVSHFVSSMGTTGTITGVSQYLKSQNPQVKVIGLQPAEGSSIPGIRRWSAEYIPGIFRPELVDQVLDITQSVAEQTMRRLAKEEGIFCGVSSGGAVAGALRIAVDNPDAVIVAIICDRGDRYLSTGVFLSKGG

SEQ ID NO: 29521 - protein, 207 aa, Oryza sativa
MTTSERDPCPDRILDDVGGAFAMGAVGGTAFHFLRGAYNSPNGHRLSGGSQAVRMSVPRTGGNFAAWGGLFSAFDCAMVHARQKEDPWNSILAGAATGAVLSLRQGPRATATSALVGASLLALVEGAGILLTRTMATLPQEDHAYPFPVVPPHEEEVSAHESSPIAWVRGFFGRKEEKPAAAGGDSKSDVLESFETPSPPIPSFDYK

SEQ ID NO: 29522 - protein, 408 aa, Oryza sativa
MGGSHAPSAQIPFPDHIVHEAGTGFALGSPFHFFKGLRGSPRGHRLAGAARAVRTGAPRAAGRFAAFCVPECGMAYARGGKEDSWNFIFAGAATSGFLRLRQGALTAGREALWSGLFFAFMEVASLAMHRALDDLPPADGRRGLAARAPVGRPRHLPASPGFPGQPIVVKEVAVADDEDDSGFSDGWFAEERHASQAQLSLLRAPIMASPSPPRPDERDTDLPLPRPPWKPYPAFVLDDAGGGFLIGGGVGSAYHAARGLLGSPSGRRLAGAARAVRANAPRISATWGARCGLYGAFKCALSLPRATYGDPVVSVLAAAAAGAAHCLRRGPIAVGRGALVGAASMAIIERADAALENLRSWVHYQRRLLPEEDIDGGGGSDPKPDDELPIGFLGVPPKPVVVEEVPAG

SEQ ID NO: 29523 - protein, 368 aa, Streptococcus pyogenes
MEHKWKLWLFIVGVVLLIGGASVLIQKGQAKAFSQGKPQLPAKKVKSTKVDPNAPVDQKVIYLAEGCFWGVEEYFSQVDGVLDAVSGYANGRGDTTNYQLIHQTGHAETVEVTYDANRISLKELLLHFFRIIDPTSLNKQGNDRGSQYRTGIYYTDKADLAIIDEVFKEKAKDYKKKIVVEKAPLKHFIKAEEYHQDYLKKNPNGYCHIDINQATYPVIDESKYPKPSATEIKAKLSADEYRVTQKNETEKAFSNRYWDSFDAGIYVDVVTGEPLFSSKDKFESGCGWPSFSRPISPDVVRYKEDKSFNMTRTEVRSRSGNSHLGHVFTDGPKDQGGLRYCINSLSITFIPKADMEAKGYGYLLSSVE

SEQ ID NO: 29524 - protein, 115 aa, Cylindrocladium colhounii
GGKAPRKQLASKAARKSAPSTGGVKKPHRYKPGTVALREIRRYQKSTELLIRKLPFQRLVREIAQDFKSDLRFQSSAIGALQESVESYLVSLFEDTNLCAIHAKRVTIQSKDIQL

SEQ ID NO: 29525 - protein, 669 aa, Arabidopsis thaliana
MRRNTDQESPIMSYYSSFFFLFLFSFLTSFRVSAQDPTYVYHTCQNTANYTSNSTYNNNLKTLLASLSSRNASYSTGFQNATVGQAPDRVTGLFNCRGDVSTEVCRRCVSFAVNDTLTRCPNQKEATLYYDECVLRYSNQNILSTLITTGGVILVNTRNVTSNQLDLLSDLVLPTLNQAATVALNSSKKFGTRKNNFTALQSFYGLVQCTPDLTRQDCSRCLQLVINQIPTDRIGARIINPSCTSRYEIYAFYTESAVPPPPPPPSISTPPVSAPPRSGKDGNSKVLVIAIVVPIIVAVLLFIAGYCFLTRRARKSYYTPSAFAGDDITTADSLQLDYRTIQTATDDFVESNKIGQGGFGEVYKGTLSDGTEVAVKRLSKSSGQGEVEFKNEVVLVAKLQHRNLVRLLGFCLDGEERVLVYEYVPNKSLDYFLFDPAKKGQLDWTRRYKIIGGVARGILYLHQDSRLTIIHRDLKASNILLDADMNPKIADFGMARIFGLDQTEENTSRIVGTYGYMSPEYAMHGQYSMKSDVYSFGVLVLEIISGKKNSSFYQTDGAHDLVSYAWGLWSNGRPLELVDPAIVENCQRNEVVRCVHIGLLCVQEDPAERPTLSTIVLMLTSNTVTLPVPRQPGLFFQSRIGKDPLDTDTTSKSLLGSVDDASITDIHPR

SEQ ID NO: 29526 - protein, 187 aa, Oryza sativa
MEEEWGAPYPDCVLDNAGAGFVGGAAAGTLAHLFTGLRDSPCGRHLAGAAQAVRDGAPRVATRWAARLAVYSAACHALSWATDRHDDPLVSVAAGAATGAVARFRHGPLAVGRAALVGAATLAAVELMIRDSVEEHDDDKPRRNQRPLPAKTKDDDVILRMPPAIDHFPVPDPFIAASRGSLLRFRG

SEQ ID NO: 29527 - protein, 431 aa, Nocardia farcinica
MTQTTASVNTQSLGELDPELAAAMAGELARERDTLEMIASENFVPRAVLQAQGSVLTNKYAEGYPGRRYYGGCENVDVVENLARERAKELFGAEFANVQPHSGAQANAAVLMSLMDPGDRLLGLDLAHGGHLTHGMRLNFSGKLYEVHSYGVSKEDHRVDMDEVRTIALGAKPKVIVAGWSAYPRHQDFAAFRAIADEVGAYLWVDMAHFAGLVAAGLHPSPVPYADVVSSTVHKTLGGPRSGLILAKQEFAKKINSAVFPGQQGGPLMHAIAAKAVAFKIAGTEEFRDRQQRTLSGAKILAERLTGADVADKGISVLTGGTDVHLVLVDLRNSQLDGQQGEDLLHEIGITVNRNAVPFDPRPPMVTSGLRIGTAALATRGFGDAEFTEVADIIATALAGGSDAETLRGRVRALAQRVPLYQGLEDWHLLG

SEQ ID NO: 29528 - protein, 119 aa, Unknown
  Candidatus Pelagibacter ubique HTCC1002
MTQTLFEKYGGKKTVGQIVINFYQKLMADENLKKFFTNSDMKVLISHQTNFISQALGGPKEYTGLDMKTAHQGMKISQEDFNGVAGHLKQTLEELNVESQDVDTIIGVVAPLSEHIVSK

SEQ ID NO: 29529 - protein, 461 aa, Salmonella typhimurium
MAEKKPELQRGLEARHIELIALGGTIGVGLFMGAASTLKWAGPSVLLAYIIAGLFVFFIMRSMGEMLFLEPVTGSFAVYAHRYMSPFFGYLTAWSYWFMWMAVGISEITAIGVYVQFWFPEMAQWIPALIAVGLVALANLAAVRLYGEIEFWFAMIKVTTIIVMIIIGLGVIFFGFGNGGQAIGFGNLTEHGGFFAGGWEGFLTALCIVVASYQGVELIGITAGEAKNPQVTLRSAVGKVLWRILIFYVGAIFVIVTIFPWNEIGSNGSPFVLTFAKIGITAAAGIINFVVLTAALSGCNSGMYSCGRMLYALAKNRQLPAAVAKVSRHGVPVAGVALSILILLVGSCLNYIIPNPQRVFVYVYSASVLPGMVPWFVILISQLRFRRAHKEAIADHPFRSIMFPWANYLTMAFLVCVLIGMYFNEDTRMSLFVGVIFLLAVTLVYKVFGLNRHGTAHKVGE

SEQ ID NO: 29530 - protein, 36 aa, Pteris vittata
NKPYPKSRYCRGVPDPKIRIYDVGMKKKGVDEFPFS

SEQ ID NO: 29531 - protein, 406 aa, Mycoplasma genitalium
MFSKVRLLLNKELQRQRENICLIASENYVSQDILAVTGSVLTNKYAEGYPSKRFYQGCEVVDESENLAIESCKTLFGAQWANVQPHSGSSANYAVYLALLKPGDTILGLDLNCGGHLTHGSPVNFSGKQYQAVTYSLDFETETLDYDAILQIALEHKPKLIICGFSNYSRTVDFKKFSAIAKQVNAYLLADIAHIAGFIAAGLHQNPLPFVDVVTSTTHKTLRGPRGGIIMSNNQAIIKKLDSGVFPGCQGGPLQHVIAAKYVCFKEALNPKFKQYMQQVKDNALAMANWFLKQGYRVVSKGTETHLFSLVVGNGKDVALWLQKANIVLNMNTIPFETKSAFSPSGIRLGTPAMTTRGFKTNDFIFVASLIDKVIKSNGNQKVISQTKTAVLNLLKRFPLYKGLAY

SEQ ID NO: 29532 - protein, 138 aa, Vibrio fischeri
MANGRILHTMIRVGNLDKSIEFYTKVMGMDLLRQNTNEEYKYTLAFLGYGDESQGAVIELTYNWGTEEYDMGTAFGHIAIGVDDIYATCDAIKAAGGNVTREAGPVKGGSTHIAFVKDPDGYMIELIQNSSASAGLEG

SEQ ID NO: 29533 - protein, 830 aa, Photobacterium profundum
MKVSRRKFIKAQAVASAAAAAGISIPISASNVVTDSSLTKITWEKAPCRFCGTGCSVNVGTKEGKVVATHGDIKSPVNRGLNCVKGYFLSKIMYGKDRLTQPLLRMTDGKFDKNGEFSPISWDQAFDIMAEKWKKTLKEKGPEAIGMFGSGQWTIYDGYAASKLMKAGFRSNNLEPNARHCMASAVVGFIRTFGIDEPMGCYDDIEAADAFVLWGSNMVEMHPILWTRVTDRRLSVPGVKVSVLSTFEHRSFELADIPIIFTPQSDLAILNFIANYIITNDKVNKDFTSKHVNFRRGTTDIGYGLRPEHPLQQAAKNPDSGDSTPMTFEEFKAFVSEYTVEKASEISGVKPDKLIELAELYANPETKVVSFWTMGFNQHTRGVWCNNLVYNIHLLTGKISTPGNSPFSLTGQPSACGTAREVGTFAHRLPADLVVTNPEHRKIAEKIWKLPDGTIPGKVGAHAVLQSRMLKDGKINAYWIQVNNNLQAGANINEETLPGYRNPDNFIVVSEAYPTVTSQAADLVLPTAMWVEKEGGFGNAERRTQLWHQMVEAPGESKPDLWQLMEFSKRFKTDEVWPKELLDSNPDYKGKTLFDVLFINGNVNKYPLDDLAEGTLNDESNYYGFYVHKGLFEEYAEFGRGHGHDLAPFDMYHETRGLRWPVVDGKETLWRYREGSDPYVKEGAGFEFYGKPDGKAIIFALPYEPAAESPDEEYDMWLSTGRVIEHWHSGSMTQRVPELYKAYPDAQVFMHPDDAKSRGLRRGDAVKVMSRRGEIITRVETRGRNKPPIGLVFVPWFDASQLINKVTLDATDPLSKQTDFKKCAVKIVKA

SEQ ID NO: 29534 - protein, 833 aa, Agrobacterium tumefaciens
MSSELTRRNLKAHAAGIAAATAGIALPAAAQPVPGGVSALQIKWSKAPCRFCGTGCGVMVGVKEGKVVATHGDMQAEVNRGLNCIKGYFLSKIMYGKDRLETPLLRKKNGVYAKDGEFEPVSWDEAFDVMAQQCKRVLKEKGPTAVGMFGSGQWTIFEGYAATKLMRAGFRSNNLDPNARHCMASAAYAFMRTFGMDEPMGCYDDFEHADAFVLWGSNMAEMHPILWTRIADRRLGFDHVRVAVLSTFTHRSMDLADIPMVFKPGTDLVILNYIANHIIKTGRVNEDFVRNHTKFVRGVTDIGYGLRPDDPVEVNAANSADPTKTEAIDFETFKEFVSEYTLEKTAAMTGVEAGFLEELAELYADPKRKVMSLWTMGFNQHVRGVWANQMVYNIHLLTGKISEPGNSPFSLTGQPSACGTAREVGTFAHRLPADMTVTNPEHRKHAEEIWRIPHGIIPEKPGYHAVQQDRMLHDGKLNFYWVQVNNNVQAGPNTKNETYLGYRNPENFIVVSDAYPTITAMSADLILPAAMWVEKEGAYGNAERRTHVWHQLVEASGEARSDLWQLVEFSKRFTTDEVWPAEILDANPAYRGKTLYEVLYKDSDVGKFPLSEINADYKNQESSDFGFYLQKGLFEEYAAFGRGHGHDLAPYDAYHEVRGMRWPVVDGKETLWRYREGYDPYVKPGEGVKFYGNKDGRAVIIAVPYEPPAESPDQEFDTWLVTGRVLEHWHSGSMTMRVPELYKAFPGARCFMNADDARKRGLNQGAEIRIVSRRGEIRSRVETRGRNRMPPGVIFVPWFDASQLINKVTLDATDPISKQTDFKKCAVKIEPVA

SEQ ID NO: 29535 - protein, 78 aa, Chaetosphaeridium globosum
MKKQNLIEMEGIVTESLPNAMFRVSLDNGCQVLAHISGKIRRNYIRILPGDKVKVELSPYDLTKGRITYRLRMKTTNG

SEQ ID NO: 29536 - protein, 387 aa, Geobacillus kaustophilus
MTEEMNVQVNVYEVGDIVRGKVVKLEDKQVLVEVENSKQSGIIPISELSNLHIEKPSDAVAVGDEVTAKVKKVEEGKDGEEGLLILSKRAVDAERAWEDLERKFASGETFETVIKDIVKGGLVADVGVRGFIPASLVEPHYVEDFSDYKGKTLAVKVVELDREKNRVILSHRAVVEEEQARQQKELLSRLEPGQVLDGVVRRIADFGVFVDVGGFDGLVHISQLSHTRVAHPSEVVKEGDAVKVKVLAVDPEQGRLSLSIKEALPGPWEGLGEKVKPGDVVTGTVKRLASFGAFVEVFPGVEGLVHVSQIANRRIGSPHEVLKEGDVVKAKVLDVNEADHRLSLSIRALLEEEAAAPAEDYSQYTRTSETRGFQLGEVIGEQLKKLK

SEQ ID NO: 29537 - protein, 184 aa, Triticum aestivum
  misc_feature (28)..(28): Xaa can be any naturally occurring amino acid
  misc_feature (82)..(82): Xaa can be any naturally occurring amino acid
  misc_feature (94)..(94): Xaa can be any naturally occurring amino acid
AWSRPRSLTVVHLVSWEKENVSSEALEXAARIACNKYMTKHAGKDAFHPQGQGFTPFHVLRINKMLSCAGADRLQTGMRGAXFGKPQGVCARVXPLGQVLLSVRCKPNNAIHATEALRRAKFKFPGRQKIIESRKWGFTKFNRNDYLKFKSEGRILPDGVNAKLLGCHGRLANRAPGQAFLSAA

SEQ ID NO: 29538 - protein, 356 aa, Novosphingobium aromaticivorans
MSGGEPVPKLSAKPAATYLRNTWYVAGWASDLAGEPQQRTFLEEPVALFRDGHGEAKAIGGRCPHRFAPLGHGSVVDGALMCPYHGLRFDGDGRCVHNPHPGGHLPDARQRVYPLVERHALLWIWMGDAAKADPASIPDFSWLSDPRWEAVRGATVAEGHFELYSDNILDLSHANFVHPALVASAFTEGERKFWQDGDNVFAEYVRLNDELSVGISAVMGTEGRPQDFYGMVKWHAPAVLYFDFRAGEPGTPREQCTLLPSLHAFTPETPDTTHYFWATARDYRLGDAEFTAGMRAALEFAFEQEDMPIIRDSHRLMRGEDFWALRPLILGGDGGGVRARRMLQRLIERERQQDAA

SEQ ID NO: 29539 - protein, 72 aa, Burkholderia mallei
MAKDDVIQMQGEVIENLPNATFRVKLENGHVVLGHISGKMRMHYIRIFPGDKVTVELTPYDLSRARIVFRAK

SEQ ID NO: 29540 - protein, 176 aa, Gossypium hirsutum
LFSFILILTHFLLKSSIRIQVLGWICVAISVSVFAAPLNIMARVVRTKSVEFMPFTLSFFLTLSAVMWFAYGLFIKDLCVALPNVLGFILGMLQMLLYAIHRHSEKVNIEEKKLPAEQMKSINVVLTTLGASEVHPVVLDIHTDDTKEEDNKNNEPTGEPDKQTDVKMEDANESPV

SEQ ID NO: 29541 - protein, 167 aa, Helianthus annuus
EFQVGPSVGISAGDELWVARYILERITEIAGVVVSFDPKPIPGDWNGAGAHTNYSTKSMRDEGGYEVIKKAIEKMGLKHKEHIAAYGEGNERRLTGRHETADINTSLWGVANRGASIRVGRDTEKEGKGYFEDRRPASNMDPYVVTSMIAETTIFVEQILKIIRFGP

SEQ ID NO: 29542 - protein, 809 aa, Herminiimonas arsenicoxydans
MKLVMVGNGMAGVRTLEELRKIAPDLYDITVFGAEPYANYNRILLSPVLAGEQTIQDIMLNDVDWYVENDIKLHLGKKIVKIDRVKRLVIADDGTTAEYDRLLLATGSNPFMLPIPGKNLEGVISYRDIYDTNAMIEAAKVHADAVVIGGGLLGLEAANGLKLRGMDVTVVHLPDTLMERQLDNVAGKMLQKSLEDRGLKFLLGKNSQEVIGDENGRVQALRFTDGTEIPAQLVVMAVGIRPNTQLAEEAGIYCNRGIVVSDTMQTYDPRIYSVGECVNHRGTAYGLVAPLFEMAKVCANHLANYGIGRYQGSVTSTKLKVTGIDLFSAGEFMGGEGTEEIMLSDPIGGVYKKLVLKEDKLVGACLYGDTVDGSWYFNLLREGKDISEIRDSLMFGEANTTRPGDTGHEGFSKAAAMPDSAEVCGCNGVCKGTIVKAIKEKGLFTIEDVRKHTKASASCGSCTGLVEQIIMATAGGDYSASSKAKSMCGCTDHTHQEVRDAIRAEKLLTVATTMERMNWRTPNGCTTCRPAINYYLISTWPHEARDDPQSRYINERAHANIQKDGTFSVIPRMWGGETSSSELRRIADVVDKFKIPTVKVTGGQRIDLLGVKKEDLRAVWHDLGMPSGLAYAKGLRTVKTCVGSEWCRFGTQDSTRMGQQLEHQLARMYAPHKVKLAVSGCPRNCAESGIKDVGIIGVDSGWEIYVGGNGGIKTEVAEFFVKLKTHEEVLEYAGAFLQLYREEGWYLERTVHYLARVGLEHAKQKVIEDAENRKALYERLLFSLEGEADPWHEPEKAMVDTRQFESLSV

SEQ ID NO: 29543 - protein, 514 aa, Aspergillus oryzae
MLSRCGRQALRLIPRTGSSSRAIAITTQLRPAAPLCVSSSISQSRSVSSSSRDGQQHEKKRQKHFINLIPSENFTSQAVLDALGSVMQNKYSEGYPGARYYGGNEHIDESERLCQQRALETFRLNPEEWGVNVQPLSGSPANLYAISALLNTHDRLMGLDLPHGGHLSHGYQTPTKKISFISKYFETLPYRLDESTGLIDYDALEKQALLYRPKLIIAGTSAYSRLIDYPRMRQIADAAGAYLLSDMAHISGLVAADVLPSPFTHSDVVTTTTHKSLRGPRGAMIFYRKGVRRTDKKGNPEMYDLENPINASVFPGHQGGPHNHTITALAVALKQAQSTEFKTYQETVLANAKALADRLGSPLSNGGLGYNIVSGGTDNHLVLVDLKNRGVDGARVERVLELCGVASNKNTVPGDRSALKPGGLRLGTPAMTTRGFQPEDFRRVADIVDRAVIITQKLDKAAKESAAAKGVKNPNTVKAFLEYVGEGEEISEIVLLRQEVEDWVGTFSLPWKDE

SEQ ID NO: 29544 - protein, 514 aa, Arabidopsis thaliana
MSGVVRSSPGSSQPPPPPPHHPPSSPVPVTSTPVIPPIRRHLAFASTKPPFHPSDDYHRFNPSSLSNNNDRSFVHGCGVVDREEDAVVVRSPIFPSEIGLEIRGCFGDFDCYLLLLSLIQKLRSVRLSSIRVNFCRLFSFAMSRKRKATMDMVVAPSNNGFTSSGFTNIPSSPCQTPRKGGRVNIKSKAKGNKSTPQTPISTNAVRSFYEISFMSRVTSLLTKKFVNLIKQAKDGMLDLNKAAETLEVQKRRIYDITNVLEGIDLIEKPFKNRILWKGVDACPGDEDADVSVLQLQAEIENLALEEQALDNQIRWLFVTEEDIKSLPGFQNQTLIAVKAPHGTTLEVPDPDEAADHPQRRYRIILRSTMGPIDVYLVSEFEGKFEDTNGSGAAPPACLPIASSSGSTGHHDIEALTVDNPETAIVSHDHPHPQPGDTSDLNYLQEQVGGMLKITPSDVENDESDYWLLSNAEISMTDIWKTDSGIDWDYGIADVSTPPPGMGEIAPTAVDSTPR

SEQ ID NO: 29545 - protein, 346 aa, Corynebacterium glutamicum
MEDMRIATLTSGGDCPGLNAVIRGIVRTASNEFGSTVVGYQDGWEGLLGDRRVQLYDDEDIDRILLRGGTILGTGRLHPDKFKAGIDQIKANLEDAGIDALIPIGGEGTLKGAKWLSDNGIPVVGVPKTIDNDVNGTDFTFGFDTAVAVATDAVDRLHTTAESHNRVMIVEVMGRHVGWIALHAGMAGGAHYTVIPEVPFDIAEICKAMERRFQMGEKYGIIVVAEGALPREGTMELREGHIDQFGHKTFTGIGQQIADEIHVRLGHDVRTTVLGHIQRGGTPTAFDRVLATRYGVRAARACHEGSFDKVVALKGESIEMITFEEAVGTLKEVPFERWVTAQAMFG

SEQ ID NO: 29546 - protein, 152 aa, Triticum aestivum
  misc_feature (133)..(133): Xaa can be any naturally occurring amino acid
MTTAPFLFPSLSRLHSARASSFPKPPVGSGAGVAFPARPYGSSLRLRSSVMAATGVGGNGSPMAPEESTVSSRLGEVKRVTKETNVHVKINLDGTGVANSSTGIPFLDHMLDQLASHGLFDVYVKATGDTHIXDDHHSNEDIALAIGTALLQ

SEQ ID NO: 29547 - protein, 315 aa, Unknown
  Acinetobacter sp. ADP1
MSARHSRLIILGSGPAGYSAAVYAARANLKPTLIAGLQLGGQLTTTTEVDNWPGDPEGLTGPALMERMQAHAERFGTEIVYDHINEVDLKTRPFVLKGDMDEYTCDALIIATGATAQYLGLESEAAFMGQGVSACATCDGFFYKNQKVMVVGGGNTAVEEALYLSNIASHVTLVHRRDSLRSEKILQDHLFAKEKEGKISIVWNHQVDEVLGDTTGVTSVRLKSTQDESTQTIDVQGLFVAIGHKPNTEMFKDQLELRDGYIQVQSGTKGNATATSVAGVFAAGDVADNIYRQAITSAGSGCMAALDADFYLDSI

SEQ ID NO: 29548 - protein, 944 aa, Herminiimonas arsenicoxydans
MSASLLTAVRLEPAASAAVSAVASPPTETKATCCYCGVGCGVLIQSDGEKVIAVRGDPDHPANFGRLCTKGSTLHLMARPALQQQSRALYPEMRLARSDERERTSWATTMDFIVNKFAATIRDQGPDSVGFYLSGQLLTEDYYVFNKLAKGLIGTNNVDTNSRLCMSSAVAGYKQTLGADAPPPCYEDIDQAEVIFIVGSNTAYAHPILYRRIEDARKANPQLKIIVADPRRTDTAREADLFLPILPGTDVALFNGMLHICLWEDLVDLDYIAAHTEDFAELKQTVREYTPKFVADICGIKEEDLMQAARMFGKSTATLSMYCQGLNQSSSGTAKNAALINLHLATHQIGKPGAGPFSLTGQPNAMGGREVGGLATMLSAHRDLANPQHRAEIAKLWGVADVPATPGKSAVEMFEAVRTGEIKIIWIVCTNPAQSMPEQAMIREALRNAELVIVQEAYKTTASCDYADVLLPASTWSEKEGTVTNSERRITRFKSVLPKLGESRHDWEIAVDFARRLEGALGKQSSIFPFESTEEIWNEHRESTRGRDLDITGLSFKLLEEQGPQQWPFPEGATTGRKRLYEDGIFPTLSGRAKFVNTVYQPVAEPVDARYPFHLTTGRLRDQWHGMSRTGTVAQLFSHASEPSVVLSKIDMERRLLNVGDLVHVTSKRGSQIFPVALGDDMRAGQAFIGMHWGEEYVSGRGRDEGGTYGVNALTSPAFDPSSRQPELKHAAVKILKAEFPWRFIVFGWIEEAKLLDLQAALRPMMRKFAYASCTLFGRDKVGVLFRAADDYAAHSALTAEIEQKFSIAGAQVLRYDDSKRGNSRRILIVDGKLQAVSLAGDISAEGWLKEYLESEQPVAALGRLLLMPSNKPPQHFKSRGRIVCNCFNVSETEINDVVITMPGNADASLGALQQKLKCGTNCGSCVPELKKIILLQDVVRSAA

SEQ ID NO: 29549 - protein, 520 aa, Methanopyrus kandleri
MCGIACAVGDDDIAAMVTAMEHRGPDGRGFASVSDDGVEFSEEPPSEGEVVLGHVRLWVRGEASAVQPIVEEDRAVAVNGEIYNYRRFVEDAPSDSWAVFEVVRSVRDAAAALRVLRGEYAFVAAFRDGTVVAARDPIGVRPLYYCVEAGLAVASERKALWAAGFRDVRRVPPGALLVLRDGRVELRNVVDVPRSRPGRSSWKDLLEVLQRSVRERVEETERVGVVLSGGVDSSTVAKLASEYVDVKCYAAGFEGSDDVEVAERLCDEMGWPFVSVSLEDEFERYVVATVYAVETWNPMKVEVGIPILACAGAMSDDGIRVMLSGQGADELLGGYHRHLRHYGDWDRFSWELWKDVAAIHAVNLERDDKAGMHHSVELRVPYLDLDVVRTGLGIDPRENVSGPEDNLRKRALRRVAAELGLPDFVVERRKRATQYGSLTSKMLDKLVRELGIKRAVAKRLGYRSHKELFLRLVGKYLGFPWEAPSVEEVERECARLGVEPEISEFLEERVLTFDSDLRAG

SEQ ID NO: 29550 - protein, 216 aa, Xylella fastidiosa
MVLTIEALKHLWRVDESRVGRTEPLPLDNRHYVNGHPLCDAFTGLAQIQFGLGCFWGAERLFWQLPGVFSTAAGYAGGGVPYPTYREVCSGETGHAEVVLVVYDHTVISFEQLLQTFWESHDPTQGMRQGNDIGTQYRSVIHCTTSEQYAAASASREVYQQQLNTAGYTAITTEILHPAPPFYYAENEHQQYLAKHPNGYCGLGGTGVTCAIRLQV

SEQ ID NO: 29551 - protein, 514 aa, Debaryomyces hansenii
MLPNSKVESNIEVDHSLSDLSSDNTVHLKRNLKNRHVSLIALAGIIGPGILIGASLALKNGGPASLIIGFGFIGLVAFSMMQSLGELATIYPTGGAFSTLGNKFVDPAFGGTVGWNYVIVWVAVLANEYNTVGSDGSIMQFWGPEVPLYGYILIFWAAFLAFQFLGVGAFGEAEYWLALFKLLGLVVFYIFSIVYVAGGVKGRPAFGFEYWNNPGAFSDGFKGVASTFVFASTFYSGTESIAIAAAETRNPSTAIPKAIRQTFWRIVIVYMGIAISYGMTVPYNDPSLNDGSKTLQSPMTIALVRAGWAQAGHLINAFILITCVSAINSSIYIGSRTIVNLAAEGFAPKLLRRVNGQGVPYMSVILMNLFGLISLMNISTGAADAYDYIVNLSGVAVFIVWGSVCYIHFRFRKAWKLQGRSIDELPYKALWFPWLAIFGLFFCIFLGLVQGWSYFKPFDAANFVDAYILLPFFVVLFVFFKIVNKTKWVKLDEIDLDDGRRHDIDVKKEVESEE

SEQ ID NO: 29552 - protein, 156 aa, Helianthus annuus
EFQVGPSVGILAGDEIWAARYILERITEIAGVVVSFDPKPIPGDWNGAGAHTNYSTKSMREEGGYEIIKKAIEKLGLRHKEHIAAYGEGNERRLTGKHETANINTFKWGVANRGASIRVGRDTEKDGKGYFEDRRPASNMDPYVVTSMIAETTILL

SEQ ID NO: 29553 - protein, 585 aa, Anabaena variabilis
MTITANSQLPNRFPQNLESMNHKADGLLATLGAELVYVQDGVGRYLSFYWQKSELLGFNQEQIVCDGNGQEIFVPLDKVSYMKRLHYVMANLAPEKFSCWFSCHQNLFELELAITPIIPPLGTAATTVLVMGRLLQVKVNNQEVNVAITTPTQTDLASRSQQHQRLVNKITRNIRRTLDLDVIWQQTVDSLGKALRLERCIICPYQPSSSKVRVIAEYHQPDRPSMLGLEIDVTSEPAFAQALTTLEPIIMEVPGYKLCPQQKILVVATCYQDQANGLIAINLRHECYPLTNAELELAKEVADQLGTAIAHATLYKELEAARQKAEEASRLKSEFLANVSHEIRTPLNGMIGFLKLILEGMADDVEEKNQFLSEAHQLSLHLLNIINDILDIAKIEAGKMELVCAPIKLEELFSDVDNFMRPQAEVKNLSFRMQLPPTSDEIVVQGNYQRLLQVMLNIVGNAIKFTHEGGITVSADVVLKKGKLQEQHFPGMVRVRIADTGIGVSLDQQDKLFQLFSQVDGSRTRQYGGTGLGLAISQKLVETMGGEVHFYSLGEGLGSTVTFTVPLYQQPVMLSSNDADAECIG

SEQ ID NO: 29554 - protein, 275 aa, Burkholderia thailandensis
MTDRHASASPFPVAALQMVSTPDRERNLAEAGRLIADAADAGARLVLLPEYFCFMGHQDTDKLALAEAYRDGPIQRFLAERAKAHGVWVIGGTLPLSAPEPSRVLNTTLVFDPQGREAARYDKIHLFNFEKGDESFDEARTIRPGDAVRTFDAPFGRVGLSVCYDLRFPELYRRMGDCAMIVVPSAFTYTTGRAHWETLLRARAVENQCYVLAAAQGGKHENGRRTWGHSMLVDPWGEVVAVRDEGAGVVAGEIDPARIADVRQSLPAWRHRVLA

SEQ ID NO: 29555 - protein, 324 aa, Gluconobacter oxydans
MPEIHHTDLLVVGAGPAGYTAAIYAARASLKPILVTGMQPGGQLTITTDVENYPGFATPVQGPWLMEQMRAQAEHVGTQLVYDLIVQADLKNGPGPDGYFRLVGDSGDEFRARTVVIATGAQAKWLGLESEKRLQRGGVSACATCDGFFYRGKTVAVIGGGNTAVEEALYLTHHADKVHLIHRRDSLRAERILQERLFSNPKVEVHWNQVVEEILGTGEPEVVCGVALKDTQTGALSRLDVDGVFVAIGHTPNAGPFRHEVACDSDGYILTESDGTGTSVKGVFAAGDIQDRIFRQAVTAAGTGCMAALEAERYLSGIPAMTKT

SEQ ID NO: 29556 - protein, 264 aa, Arabidopsis thaliana
METDKRWSLAGKTALVTGGTRGIGRAVVEELAKFGAKVHTCSRNQEELNACLNDWKANGLVVSGSVCDASVRDQREKLIQEASSAFSGKLNILINNVGTNVRKPTVEYSSEEYAKIMSTNLESAFHLSQIAHPLLKASGVGSIVFISSVAGLVHLSSGSIYGATKGALNQLTRNLACEWASDNIRTNCVAPWYIKTSLVETLLEKKEFVEAVVSRTPLGRVGEPEEVSSLVAFLCLPASSYITGQVISVDGGFTVNGFSYAMKP

SEQ ID NO: 29557 - protein, 269 aa, Corynebacterium diphtheriae
MKKFTEISSRNRKLFKLAGMFSSSESWTASVSLIGGGPGAWDLITVRGMHRLQQADVILADHLGPASELAQLCDVSTKDIIDVSKLPYGKQVAQSKINELLIEHAQAGKKVARLKGGDPYIFGRGFEELQACAKHGIACEVVPGVTSAVSVPALAGIPITQRGVVHSFTVISGHVPPQHPQSLNDWEALARTGGTLSVIMGVKNAGAIAQALIDAGRGADTPVAVVQEGSTENQKSFKTTLAQLGQAMKDNDIKPPAVYVIGEVAGLQA

SEQ ID NO: 29558 - protein, 327 aa, Oryza sativa
MAIPTKEEVEQNEEDNTFSRLQLLAQQRHAMEEFWRRSQEQIEASAGNHEHILPIDCVKNVIRPKNDAMMLSADTPTFVTKLCELFVQELTLRAWVCANSHNRDIILGTDIAEAITTTESYHFLGNVLRSHKALGSTAPDIDTSARKHIKLDQMTSLYHPTQEMQASRLAGYPPHVPIYPPIGQMGTQHKLSPFTFMMQGESLLNMKREKSLVNEVMVCTNKMSINNFDGATSIGGGSSSDVAIVVQQGETTHPFSSQNACPSLEDNYVVPMPTGHVQSFSPPTNINVKKLHQEEKNIYSQDVAEEDMSNESLEGSQKDEDLFLHEK

SEQ ID NO: 29559 - protein, 498 aa, Leptospira interrogans
MQTALYISVLIISSCGLVYELLAGTIASYLLGETVTQFSLIIGTYLFSMGVGSWLSKYLEKDLIPKFLEIELAIGLVGGFSSAILYLSFGQIRYFQIPLFLLVILIGILVGLEIPVLLRILKKELQFKELVSRVLSLDYVGALLASILFPIFFAPKLGLMRTGFIFGILNVGVALWGTWVLPLRQSKIIILRAQSVVVLTLLILGFSYSDLITYYSEESLYTDEIILSKQTQYQRIIVTRWKNEIRLFLNGHLQFSSRDEYRYHETLVHPALLAHPTPKKVLVLGGGDGLAVREILKHKNVESVTLVDLDSAITNLFSEHGILKKLNEESLKNSKVTVINTDAFLWLEESDQIFDVVLIDFPDPSNFSLGKLYTTAFFHTLKRRMNETSVLEIQSTSPLFARSSYWCIERTIASLGFYTLPLHVYVPSFGEWGFVLAGQRPIQFKKDFPKDLKFLNIQELESIQTFPQDMSRVPVEINRLDNQALVRYYDREWNRILD

SEQ ID NO: 29560 - protein, 246 aa, Triticum aestivum
MVSADVARNIVGIIGNVISFGLFLSPVPTFWRIYKAKDVEEFKPDPYLATLMNCLLWFFYGLPIVHPNSTLVLTINGIGLVIEGAYIIIFIIYAANNTRWKMLGVLAIEAAFMAAVVAGVLVGAHTHEKRSMIVGILCVIFGSIMYASPLTIMGKVIRTKSVEYMPFFLSLVNFLNGLCWTGYALIKFDIYITIPNALGTIFGLIQLILYFYYYKSTPRKGKNVELPTVLTKNAVTSGNVSVTVEK

SEQ ID NO: 29561 - protein, 350 aa, Coccidioides immitis
MTALPEPFASIPRKALLLEPSPIHLLPNMTADLGGAVKIYAKRDDLNSGLAYGGNKTRKLEYLVADALATKCDTLISIGGIQSNHTRQVAAAAAHAGLKAKLVQEKWVEWSDPGYESVGNIQLSRLMGADVRIERMAGFGIEHKDSLKNLLKECEDKGEKPYYIPAGASDHPLGGLGFARWAFEVREQEQQMGITFDNIVVCAVTGSTMAGMVAGFKLIEKLYPDEPKKKVIGIDASATPAETRAQVLRIAKNTGEKIGLEPEDITASDIMIDERYHAGTYGVPDKQTWDAIEYGARMEAFITDPVYEGKSLAGLIDMVRKGEISGGNVLYAHLGGQLALNAYSQIGTVA

SEQ ID NO: 29562 - protein, 309 aa, Oceanobacillus iheyensis
MAIYESIQQLIGNTPLLRINEMDIPNNVHLYAKLEFLNPGGSVKDRLGQYLIDKAWEQGFLREGSTIIEPTAGNTGIGLALAARTKKLSVIFCVPEQFSVEKQQIMRALGATIIHTPKEKGMMGAIEKAEQLVEEIPNSYSPQQFSNKFNPMTYYETMAPEIWSDLQGDIDIFVAGAGSGGTFTGCASYFKERKNSIHNVIVEPVGSILGGGEAGPHLTEGIGMEFIPEYMNQSFMDEVQTISDKEAFSMVEELARKEGLLVGSSSGSAMVAALNKAREARSGTTIVTILPDGSDRYLSKQIYNVSKQL

SEQ ID NO: 29563 - protein, 740 aa, Shigella flexneri
MPFIARYRKEITGGLDDTQLRNLETRLSYLRELEERRQAILKSISEQGKLTDDLAKAINATLSKTELEDLYLPYKPKRRTRGQIAIEAGLEPLADLLWSDPSHTPEVAAAQYVDADKGVADTKAALDGARYILMERFAEDAALLAKVRDYLWKNAHLVSTVVSGKEEEGAKFRDYFDHHEPLSTVPSHRALAMFRGRNEGVLQLSLNADPQFDEPPKESYCEQIIMDHLGLRLNNAPADSWRKSVVSWTWRIKVLMHLETELMGTVRERAEDEAINVFARNLHDLLMAAPAGLRATMGLDPGLRTGVKVAVVDATGKLVATDTIYPHTGQAAKAAMTVAALCEKHNVELVAIGNGTASRETERFYLDVQKQFPKVTAQKVIVSEAGASVYSASELAAQEFPDLDVSLRGAVSIARRLQDPLAELVKIDPKSIGVGQYQHDVSQTQLARKLDAVVEDCVNAVGVDLNTASVPLLTRVAGLTRMMAQNIVAWRDENGQFQNRQQLLKVSRLGPKAFEQCAGFLRINHGDNPLDASTVHPEAYPVVERILAATQQALKDLMGNSSELRNLKASDFTDEKFGVPTVTDIIKELEKPGRDPRPEFKTAQFADGVETMNDLQPGMILEGAVTNVTNFGAFVDIGVHQDGLVHISSLSNKFVEDPHTVVKAGDIVKVKVLEVDLQRKRIALTMRLDEQPGETNSRRGGGNERPQNNRPAAKPRGREAQPAGNSAMMDALAAAMGKKR

SEQ ID NO: 29564 - protein, 458 aa, Novosphingobium aromaticivorans
MNGINANRPHLPLARILEMNLGFLGLQFSFGLQQGNMGPIYSYLGADESQLPMLQLAGPITGLLVQPIIGAMSDRTASRWGRRTPYFLIGAVLCAFGLFFMPLSSSILMAMSLLWILDAGNNITMEPYRAYVSDRLNPEQRQAGFLSQSAFTGLAQMLAFLTPSLLVGLGMNQDWVDSHGIPYTVRIVFMIGAVLSLSTILWSVLRVPELPLTPQERAHIQAQPKGAWATLREIGEAIADMPVAMRKLGLMSLFQWVGMSGYWTYAVYSISRTVYGTSDVHSSAFHTAVLTNGEVAAFYNAISFVTAFAMVPLVRRLGPGPLHALCLFAGGVGMFLLPNVTDKALLFLPAIGIGLAWGSIMGNPYAILTNSIPPQRTGVYMGIFNMMIVIPMLIFAVVMSRLDLGFVSLGFDAYKQVLGGDPRNMLMFCGASLVLAGFSVLWVREGRAGAMPQSAVPA

SEQ ID NO: 29565 - protein, 423 aa, Geobacillus kaustophilus
MAADKHTEEKEQQYDVLASTQIVIHRALEKLGYPEEVYELLKEPIRVLTVRIPVRMDDGSVKIFTGYRAQHNDAVGPTKGGVRFHPDVTEREVKALSIWMSLKCGIVDLPYGGGKGGIVCDPRTMSFRELERLSRGYVRAISQIVGPTKDIPAPDVFTNSQIMAWMMDEYSRIREFDSPGFITGKPLVLGGSHGRETATAKGVTICIREAAKKRGLSLKGARVVVQGFGNAGSYLAKFMHDAGAKVVGISDVYGALYDPNGLDIDYLLERRDSFGTVTKLFKNTISNQELLELDCDILVPAAIENQITAENAPRIKASIVVEAANGPTTLEATEILTQRGILLVPDVLASAGGVTVSYFEWVQNNQGYYWTEEEVEQRLEKVMVKAFNNVYEMAQTRRVDMRLAAYMVGVRKMAEACRFRGWV

SEQ ID NO: 29566 - protein, 322 aa, Mycoplasma hyopneumoniae
MSKKIGILTSGGDAPGMNSAISFLAKSALSLGFEPYLIFDGYSGIIARKILPAKNFPYNGISSFGGTAIGSSRFPEFKKEEVQNKAVEILSEIGISSLVVVGGDGTYNGGYKLHLKGIKVIALPGTIDNDIQFTDYTIGFDTALNTIVETIDKLRDTANSHRRCFVVEVMGRHCQDLALYSAIATGSEILITNTNILTPEEVSQRVLEQFAKGKPSVIVTITENILPNLKEFAAKIEELTKISTRSLEVGHTQRGGRPSAFDRILAAKMAMKAMELINQDKSGLAISYLDGKIQTFDIAKVVSKPVRKTNDLVLEINKINQN

SEQ ID NO: 29567 - protein, 159 aa, Unknown
  Shewanella sp. MR-4
MALATFGAGCFWGVEYFFRQVNGVTNATCGYMGGNNDATTYEEVKKGKTGHAEVVQVEFDPAIVSYDELLDVFWKNHNPTTLNMQGGDIGTQYRSTIFFHDREQKATAEASKLAFARSGRWGLRHIVTEIVPLQQFHVAEEYHQNYIDKNNLPSCHLEY

SEQ ID NO: 29568 - protein, 574 aa, Arabidopsis thaliana
  misc_feature (480)..(480): Xaa can be any naturally occurring amino acid
MNHSTSDQSLYIESDDGDDERKHLSDDEDDDGTLSDTSDAYNQNQHHLSKASPYSTAWPKSYRQSIDMFGSVPSPNLGFLANSSMSRRGSSFMSSTLTRRHTPESLPCVTKPLLEDEEAPKHKLSTHSLLPSKPSSSMVVSHDMGISNDSSFGQAVLNGVNVLCGVGILSTPYAVKEGGWLGLIILFAFGILCFYTGLLLRYCLDSHPDVQTYPDIGHAAFGSTGRILVSVILYMELYAMSVEYIILEGDNLSSMFPNASLSIGGFHLDAPRLFALLTTLAVLPTVWLRDLSVLSYISAGGVIASVLVVLCLFWVGLVDDVGIHSKGTPLNLATLPVSVGLYGYCYSGHGVFPNIYTSMAKPSQFSAVLLASFGICTLMYAGVAVMGYSMFGESTESQFTLNLPQDLVASKIALWTTKESTYALTLSPVAMSLEELIPSNYGKSRFYAIAIRSALAISTLLVGLAIPFFGLVMSLIGSFXDNAHYADTTASLFLEHLKEKSNPYSDLVSQTLQVKTIMKSCLGFIFNWDLYFTIISSEGVAGEGTLADSVAEFDELQTLVTEASFASRITDNCL

SEQ ID NO: 29569 - protein, 557 aa, Suaeda salsa
MWSQLSSFFASKMDMVSTSDHASVVSMNLFVALLCGCIVIGHLLEENRWMNESITALLIGLSTGIIILLISGGKSSHLLVFSEDLFFIYLLPPIIFNAGFQVKKKQFFRNFITIILFGAVGTLVSFIIISLGSIAIFQKMDIGSLELGDLLAIGAIFAATDSVCTLQVLNQDETPLLYSLVFGEGVVNDATSVVLFNAIQNFDLTHIDHRIAYRIAFQFGGNFLYLFFASTLLGAVTGLLSAYVIKKLYFGRHSTDREVALMMLMAYLSYMLAELFYLSGILTVFFCGIVMSHYTWHNVTESSRVTTKHAFATLSFVAEIFIFLYVGMDALDIEKWRFVSDSPGTSVAVSSILLGLLMVGRALLFSLVFLMNLSKKSNSEKVTFNQQIVIWWAGLMRGAVSVALAYNQFSRSGHTQLRGNAIMITSTITVVLFSTMVFGLLTKPLILFMLPQPKHFTSASTVSDLGSPKSFSLPLLEDRQDSEADLGNDDEEAYPRGTIARPTSLRMLLNAPTHTVHHYWRRFDDYFMRPVFGGRGFVPFVPGSPTEQSTTNLSQRT

SEQ ID NO: 29570 - protein, 249 aa, Hydrogenobacter thermophilus
MGKVYIVGAGPGDPELLTLKAYRLIKSADVVLYDRLVNPEILLLAKPECQLIYVGKEEGKHTIEQEKINELLLHYAHTKEVVVRLKGGDPFVFGRGSEEALFLAQHGVEVEVVPGISSATGVPAYAGIPITFRRLSSSFAVITGHEDPKKGSSSVDWESLKGINTLVFLMAVSNRKEIARRLIEVGRDPKEPVAFIERGTTREQRVVITDLYELANDPPEVNPPAVMVVGQVVRLSPYCGQVSATWQAI

SEQ ID NO: 29571 - protein, 266 aa, Herminiimonas arsenicoxydans
MVVRMEQFGKVFLVGAGPGDPDLLTIKAVKAIARADVILIDDLVNPEVLQYAQAIARIVSVGKRGGCKQTPQEFIERLMLFEAQAGQCVVRLKGGDPFIFGRGGEERDHLQAEGVDVEVINGISSGLAAPASIGVPLTHRDWSQGVIFITGHGKNAESNPDWYTLAKLNLTLVIYMGVARCTEIQAALLEGGKAGRTPVAVIQSATGVAQRQLITILSELPQALAKSAIGSPAIIVIGDVVRCATEFARQSNVQTLRDIVLQKMTA

SEQ ID NO: 29572 - protein, 480 aa, Neurospora crassa
MPSNTQTEFAPAPERNPDKYGPNANNNQKKCSQLASDFFKDSVKRARERNQRQSEMEQKLGETNDARRRESIWSTAGRKEGQYLRFLRTKDKPENYQTIKIIGKGAFGEVKLVQKKADGKVYAMKSLIKTEMFKKDQLAHVRAERDILAESDSPWVVKLYTTFQDANFLYMLMEFLPGGDLMTMLIKYEIFSEDITRFYIAEIVLAIDAVHKLGFIHRDIKPDNILLDRGGHVKLTDFGLSTGFHKLHDNNYYTQLLQGKSNKPRDNRNSVAIDQINLTVSNRAQINDWRRSRRLMAYSTVGTPDYIAPEIFTGHGYSFDCDWWSLGTIMFECLVGWPPFCAEDSHDTYRKIVNWRHSLYFPDDITLGVDAENLIRSLICNTENRLGRGGAHEIKSHAFFRGVEFDSLRRIRAPFEPRLTSAIDTTYFPTDEIDQTDNATLLKAQQAARGAAAPAQQEESPELSLPFIGYTFKRFDNNFR

SEQ ID NO: 29573 - protein, 91 aa, Glycine max
MSSRRSRQQSASTRISDDQIIDLVSKLRQLVPEIRDRRSDKVSASKVLQETCNYIRSLHREVDDLSERLSQLLATIDADSPEAAIIRSLIN

SEQ ID NO: 29574 - protein, 625 aa, Oryza sativa
MQRSRRALLKRKAAAAAKEEEEEAGVGVATAAAAGRRRRRRLYGFSVSLVVACWVVLLLLNPLVGHGNGQRDEGIFADEGSSDPSFDSVEPTLSEGSVDSVVQQENGENHALPGDSCAKPDENHVLSEETLLEKDQLCSNDEAQGDSMDALPKDNVDQGENLPRTDDDSVVHPEGEVESEGVPRPARLSRVVPPGLDEFKTRAIAERGKGVPSGQPGNVIHRREPSGKLYNYASAAKGAKVLEFNKEAKGASNILDKDKDKYLRNPCSAEGKFVIIELSEETLVDTIAIANFEHYSSNLKEFEMLSSLNYPTDSWETLGRFTVANAKIAQNFTFPEPKWARYLKLNLLSHYGSEFYCTLSMLEVYGMDAVEKMLENLIPVENKRLEPDDKMKEPVDQQTQLKEPTEGKESSHEPLDEDEFELEDDKLNGDSSKNGAHDQVTETRPIQAGRIPGDTVLKVLMQKVQSLDVSFSVLERYLEELNSRYGQIFKDFDADIDTKDALLEKIKLELKHLERSKDDFAKEIEGILSWKLVASSQLNQLLLDNVIIRSELERFREKQADLENRSFAVIFLSFVFGCLAIAKLSIGMIFNTCRLYNFEKFDRVKSGWLVLLFSSCIIASILIIQ

SEQ ID NO: 29575 - protein, 486 aa, Yersinia pestis
MALRLVTGVILQTGVFLMSKQQIGVVGMAVMGRNLALNIESRGYSVSIFNRSSDKTDEVVAENPGKNLVPSYTVEEFVDSLEKPRRILLMVKAGEATDKTIASLTPHLDKGDILIDGGNTYYKDTIRRNRELSAQGFNFIGTGVSGGEEGALKGPSIMPGGQKEAYELVAPILEKIAARADDGDACVAYIGADGAGHYVKMVHNGIEYGDMQLIAEAYSLLKQSLGLSNEELASTFAEWNKGELNSYLIDITKDIFTKKDEDGNYLVDVILDEAANKGTGKWTSQSSLDLGEPLTLITESVFARYLSSLKDQRVAASKVLTGPKVQPFTGDKAEFIEKIRRALYLGKIVSYAQGFSQLKAASNENNWDLNYGEIAKIFRAGCIIRAQFLQKITDAYAENADIANLLLAPYFKQIADEYQQALRDVVSYAVQNGIPTPTFSAAINYYDSYRSAVLPANLIQAQRDYFGAHTYKRTDKEGVFHTEWMA

SEQ ID NO: 29576 - protein, 159 aa, Helianthus annuus
EFQVGPSVGISAGDEIWAARYILERITEIAGVVVSFDPKPIPGDWNGAGAHTNYSTKSMREEGGYEIIKKAIEKLGLRHSEHIAAYGEGNERRLTGRHETANINTSKWGVANRGASIRVGRDTEKEGKGYFEDRRPASNMDPYVVTSMIAETTILYVNP

SEQ ID NO: 29577 - protein, 174 aa, Helianthus annuus
GFQVGPSVGIEAGDHIWCARYLLERITEQAGVVLTLDPKPIEGDWNGAGCHTNYSTKAMREDGGFEVIKKAILNLSLRHTEHISAYGEGNERRLTGKHETASINQFSWGVANRGCSIRVGRDTEKAGKGYLEDRRPASNMDPYTVTGLLAETTILWEPTLEAEALAAQKLALNV

SEQ ID NO: 29578 - protein, 434 aa, Triticum aestivum
  misc_feature (49)..(49): Xaa can be any naturally occurring amino acid
  misc_feature (153)..(153): Xaa can be any naturally occurring amino acid
  misc_feature (174)..(174): Xaa can be any naturally occurring amino acid
  misc_feature (190)..(190): Xaa can be any naturally occurring amino acid
  misc_feature (203)..(203): Xaa can be any naturally occurring amino acid
  misc_feature (219)..(219): Xaa can be any naturally occurring amino acid
  misc_feature (239)..(239): Xaa can be any naturally occurring amino acid
  misc_feature (263)..(263): Xaa can be any naturally occurring amino acid
  misc_feature (301)..(301): Xaa can be any naturally occurring amino acid
  misc_feature (317)..(317): Xaa can be any naturally occurring amino acid
MAQAVVPAMQCQVGVRGRSAVPARQPAGRVWGVRRTARATSGFKVLALXPETTGVIQRMQQLLDMDTTPFTDKIIAEYIWVGGSGIDLRSKSRTISKPVEDPSELPKWNYDGSSTGQAPGEDSEVILYPQAIFKDPFRGGNNILVICDTYTPXGNPIPTNKRHMAAQIFSDPKXVTAQVPWFGIEQEYTXLCKGIVNWPLGWXPLEGTPGPQGPYYCAXVGSDKSFGRDISDAHYKACXLYAGIEISGTNGEVMPGQWEYQVXGPSVGIDAGDHIWASRYILERITEQAGVVLTLDPKPIXQGDWNGAGCHTNYSTXAMREDGGFDVIKKAILNLSLRHDLHIAAYGEGNERRLTGLHETASISDFSWGVANRGCSIRVGRETEAKGKGYLEDRRPASNMDPYTVTALLAETTILWEPTLEAEALAAKKLALKV

SEQ ID NO: 29579 - protein, 754 aa, Brevibacterium helvolum
MEVWPGNAYPLGATFDGTGTNFALFSERAERVELCLLADDLTETRIELTEVDGYVWHCYLPHIQPGQKYGYRVHGPYDPASGNRFNPNKLLMDPYAKAVAGQIDWVIDPALFSYEFGDPDSRNDADSAPHTMHGVVINPFFEWDGDRQLKIPYHQSVIYEAHVKGLTQLHPEIPEEQRGTYAGVAHPAVIEHLKKVGATAIELMPVHQFVNDGTLVEKGLNNYWGYNTIGFFAPQNTYSATGDVGHQVQEFLVMVRDLHRAGIEVILDVVYNHTAEGNHLGPTLSFKGIDNQAYYRLVDNNCKHYMDYTGTGNSLNVRHPHSLQLLMDSLRYWVTEMHVDGFRFDLASTLAREFYDVDKLSTFFELIQQDPVVSQVKLIAEPWDVGPGGYQVGNFPPQWTEWNGKFRDTVRDFWRGEPSTLGEFASRLTGSADLYESSARRPVASINFVTAHDGFTMRDLVSYNEKHNDANGEGNNDGESHNRSWNCGVEGDTDDEKVLALRARQQRNFIGTLLLSQGVPMLLHGDELGRTQQGNNNTYCQDSELSWIHWEAMDQPLVEFTAFVNKLRHDHPTFRRSRFFDGRPVRRGEGEKLPDIVWLKTDGTEMLPEDWGSGFGRTIGVFYNGDGIQEQDSRGRRITDDSFIMAFNAHDDAVDFCLPAEEYSQYWEVQFDTAAQADDYEPLKAGATLKLDAKSMVVLRAYSGPEEEVDYSAAASVASMAEQEEAQEEMVEAQTKAAEASEARATGADEDAKA

SEQ ID NO: 29580 - protein, 174 aa, Helianthus annuus
GSQVGPSVGIEAGDHIWCARYLLERITEQAGVVLTLDPKPIEGDWNGAGCHTNYSTKAMREDGGFEVIKKAILNLSLRHTEHISAYGEGNERRLTGKHGTASINQFSWGVANRGCSIRVGRDTDAAGKGYLEDRRPASNMDPYTVTGLLAETPFLWEPSLEAEALAAQKLALNV

SEQ ID NO: 29581 - protein, 174 aa, Helianthus annuus
GFQVGPSVGIDSGDHIWRARYLLERITEQAGVVLTLDPKPIEGDWNGAGCHTNYSTKAMREDGGFEVIKKAILNLSLRHTEHISAYGEGNERRLTGKHETASINQFSWGVANRGCSIRVGGDTEKAGKGYLEDRRPASNMDPYTVTGLLAETTILWEPSLEAEALAAQKLALNV

SEQ ID NO: 29582 - protein, 420 aa, Arabidopsis thaliana
MAASVQPACLDLHFSGKHPPLLKHNAIIVRCVSSPNVIPEADSISGPPDIINTNRDQRKVVRIAWEKLVRWSRSLRAKAKTDVLERTRKVVVLGGGSFGTAMAAHVARRKEGLEVNMLVRDSFVCQSINENHHNCKYFPEHKLPENVIATTDAKAALLDADYCLHAVPVQFSSSFLEGIADYVDPGLPFISLSKGLELNTLRMMSQIIPIALKNPRQPFVALSGPSFALELMNNLPTAMVVASKDKKLANAVQQLLASSYLRINTSSDVTGVEIAGALKNVLAIAAGIVDGMNLGNNSMAALVSQGCSEIRWLATKMGAKPTTITGLSGTGDIMLTCFVNLSRNRTVGVRLGSGETLDDILTSMNQVAEGVATAGAVIALAQKYNVKLPVLTAVAKIIDNELTPTKAVLELMNLPQIEEV

SEQ ID NO: 29583 - protein, 589 aa, Triticum aestivum
  misc_feature (36)..(36): Xaa can be any naturally occurring amino acid
  misc_feature (60)..(60): Xaa can be any naturally occurring amino acid
  misc_feature (71)..(71): Xaa can be any naturally occurring amino acid
  misc_feature (97)..(97): Xaa can be any naturally occurring amino acid
MCGILAVLGCADDTQGKRVRVLELSRRLKHRGPDWXSGMHQVGDCYLSHQRLAIIDPASXGDQPLYNEGQXSSSVTVNGEIYNHEQLRAQLSSHTFXRTGSDCEVIAHLYEGHGENFIDMLDGVFSFVLLDTRDNSFIAARDAIGVTPLYIGWGIDGSVWISSEMKGLNDDCEHFEIFPPGHLYSSKQGGFKRWYNPPWFSEVIPSVPYDPLALRKAFEKAVIKRLMTDVPFGVLLSGGLDSSLVAAVTVRHLAGTKAAKRWGTKLHSFCVGLEGSPDLKAAKEVANYLGTMHHEFTFTVQDGIDAIEDVIYHTETYDVTTIRASTPMFLMSSKIKSLGVKMVISGEGSDEIFGGYLYFHKAPNKEELHRETCQKIKALHQYDCLRANKATSAWGLEARVPFLDKEFINEAMSIDPEWKMIRPDLGRIEKWVLRKAFDDEEQPFLPKHILYRQKEQFSDGVGYSWIDGLKAHAESNVTDKMMSNAKFIYPHNTPTTKEAYCYRMIFERFFPQNSAILTVPGGPSVACSTAKAVEWDAQWSGNLDPSGRAALGVHLSAYEQEHLPATILTGTSKKPRMIEVAAPGVAIES

SEQ ID NO: 29584 - protein, 325 aa, Solanum tuberosum
MAGEKIGIAKDVTELIGNTPLVYLNNVVDGCVARVAARLESMEPCSSVKDRIGYSMITDAEEKGLIKPGESVLIEPTSGNTGVGLAFMAAAKGYKLIITMPSSMSLERRIILRAFGAELVLTDPAKGMKGAISKAEEIKAKIPNSYILQQFENPANPKIHYETTGPEIWKGSNGKVDALVSGIGTGGTITGSGKYLREQNPNVKLYGVEPVESAILSGGKPGPHKIQGIGAGFIPGVLEVNLIDDVVQVSSEESIEMAKLLALKEGLLVGISSGAAAAAAIKVAKRPENAGKLIVVIFPSFGERYLSSVLFETVRREAENMTVEP

SEQ ID NO: 29585 - protein, 468 aa, Unknown
  Candidatus Kuenenia stuttgartiensis
MNILVINVSMRQTSPLKLFPIGLGYITTSMKNAGFTFDLLDIDAHRYSDQEVEQFIRKKNYDIVCMGCIVTGYKIVKMLASFIKESHPNATIIVGNSVATSIADTLLTKTQVDVAVMSEGDETIVELLNAISRSESLEQVKGICFKKDGKIVRTPMRPLIKDISTLPFIDYTIFDVETYIKTSKLAVSDPLPIPREDIRALPVNTARGCVAGCSFCYHVFKKTPYRYRNPDNIMTELRQLIKQYNLNYILLWDEVTFFSKQQTVAFVDRILEEGLQFYWAGLCRANLFQDDDDIEIMKKMKRAGCIAMVYSLESAEPEILKAMNKNISVEQFSLQTQLFRKAEIPVFTSLVIGFPQETPESLKKTFNCCIENRIYPSAGYLLPQPGSVMYDYAFQHGFIKDEEEYLLKMGDRQDLRLNMTAMSDKELESHVLEGLKRCNDEMNVGLQYEDLIKTMYFRSSKSDKSQVS

SEQ ID NO: 29586 - protein, 253 aa, Haloarcula marismortui
MTDAAPGKVYLVGSGPGDPDLLTVKAKRLLEEADVVLHDKLPGPEIIGMIPEEKREDVGKRAGGEWTPQEYTNARLVELAEEGNTVVRLKGGDSMVFGRGGEELAHLAENGIPVEIVPGITSAIAGPEAAGIPVTHRDYTSSVSFVTGHEDPTKDESAVDWDALAATGGTLVVLMGVGKLPQYTDALRDAGMDPDTPVALVERATWPDQQVATGTLDTIVSVRDEAGIEPPAITVIGEVAGERERVLEFLEGY

SEQ ID NO: 29587 - protein, 357 aa, Anabaena variabilis
MRKKIGILTSGGDCPGLNCVIRAVVSHATLTYDWEVFGIPYATQGLLERQAIALNMHGWDLRGIDPLLNMGGTILGTINKGDTLAHVDEMLASYEALALDALIVIGGDGSLGILHELASRGNWNLVAIPKTIDSDVALTERAVGFDTAVNTIVDALNRLTFTAASHDRVMIVEVMGRSAGHLALHAGIAGGADVILIPEISYTISGLCQYIAELRDRWQRKFAIVVVAEGAKLCLEDVQENIASACVSPKCGRGQYIAEQIARCSKNLIDTRVSVLGHIQRGGIPSALDRLTATVFGKTAVDLVAQGKFGQMVAWQNGEAIPVPIQDVVAQSPLHVNPQGSLVQSARCLGIYVGEKT

SEQ ID NO: 29588 - protein, 350 aa, Triticum aestivum
ILQYLGLRGNSLTGTLSPDMCQLTGLWYFDVRGNNLTGTIPQSIGNCTSFARPDISSNKISGEIPYNIGFLQVATLALQGNRLTGKIPEVIGLMQALAVLDLSENELVGAIPPILGNLSYTGKLYLHGNKLTGEVPPELGNMTKLSYLQLNDNELVGTIPAELGKLEELFELNLANNNLEGPIPTNIISCTALNKFNVYGNRLNGSIPAGFQNLESLTNLNLSSNNFKGHIPSELGHIINLDTLDLSYNEFSGPVPATIGDLEHLLQLNLSKNHLSGSVPAEFGNLRSIQVIDLSNNAMSGYLPEELGQLQNLDSLILNNNILVGEIPAQLANCFSLNILNLSHNNFSGH

SEQ ID NO: 29589 - protein, 360 aa, Cicer arietinum
LERHELVPTVWNEYGWDKVSNILYVDQPTGTGFSYSSDLRDIRHNEKGVSNDLYDFLQAFFAEHPQYAKNNFFITGESYAGHYIPALASRIRQGNQAKEGIHINLKGLAIGNGLTNPAIQYKAYADYALDMGIITKATHDRLGLVLVPACELAIKLCGTDGKLACLTANVACNLIFSDILLHAGDVNYYDIRKKCEGSLCYDFSNMEKFLNQESVRDSLGVAKISFVSCSTEVYIAMLVDWMRNLEVGIPILLEDGINLLVYAGEYDLICNWLGNSRWVHAMEWSGQKKFVASPDVPFVVNGSEAGLLKNYGPLSFLKVYDAGHMVPMDQPKAALEMLKKWTRGTLAESKVGEEEFVADM

SEQ ID NO: 29590 - protein, 279 aa, Solanum tuberosum
MFQTLKNEFQICEEIGRGRFGTVYRCFSPATGESFACKSIDKNLLIDSTDRECLDKEPKILQLLPGNPNILHLYKVYEDDDFLHMVTDFCPNSDLYERVSSGSLSESAAAAILTQLVSAISYCHHMGVAHRDIKPDNVLFDSENRLKLADFGSAEWFAGCEGRMMSGVVGTPYYVAPEVLMGKEYNEKVDVWSAGVILYIMLSGVPPFYGETPTETFQAVLRGNLRFPTRNFRSVSSEAKDLLRKMICKDVSRRFSAEQVLRHPWVINGGETRSMADLN

SEQ ID NO: 29591 - protein, 896 aa, Pseudomonas viridiflava
MAAVLGGYFTWMQLYELQSQLLQRGEMIAQDLAPLSANALGRKDKILLTRIATQTLEQSDVRAVSFLDTDRSVLAHAGPTMISPSPIGSSTQLLNSSGNDATRYLLPVFGHQRHLTSPIIPAEADTLLGWVELEISHNGTLLRGYRSLFASLLLIFTGLAFTAILAVRMSRTINGPLSQIKQAVSQLKDGNLETRLPPLGSRELDELASGINRMAATLQNAQEELQMSIDQATEDVRQNLETIEIQNIELDLARKEALEASRIKSEFLANMSHEIRTPLNGILGFTHLLQKSELTPRQYDYLGTIEKSADNLLSIINEILDFSKIEAGKLVLDNIPFNLRDLLQDTLTILAPAAHAKQLELVSLVYRDTPLALSGDPLRLRQILTNLVSNAIKFTRQGTIVARAMLEDETEEHAQLRISVQDTGIGLSSQDVRALFQAFSQADNSISRQPGGTGLGLVISKRLIEQMGGEIGVDSTPGEGSEFWISLNLPKAREDREETANQALEGLRAAVLEHHDLARQALEHQLEDCGLQTVVFTNLENLLNGVTAAHETPQAIDLVVLGVTALEISPERLRQHIWDLENLNCKVMVLCPTTEHALFQMSVHDVYTQLQAKPACNRKLQKALSELVAPRAVRTDVALPLSSRAPRVLCVDDNPANLLLVQTLLEDMGAEVVAVDGGYAAVSAVQQEAFDLVLMDVQMPGMDGCQATEAIRAWETERNQTSLPIVALTAHAMANEKRSLLQSGMDDYLTKPISERQLAQVVLKWTGLALRNPIPERQTESSNAHVGPLVLDHEEGLRLAAGKPDLAADMLAMLLASLDADREAIRAARANDDIQGLIERVHRLHGATRYCGVPQLRTACQRAETLLKQNAPHTEDALDDLDKAITRLEAEARVTA

SEQ ID NO: 29592 - protein, 800 aa, Oryza sativa
MASLPAPPTPLGSCPRGRGGGRVVARPRRAGLACAARSCYRFRTDDDGVVDVAVSGEDGDGGGGGYAVSVEVPGTRGREGGLVLRASGSGEGVPLAPAAGGASLAAELSFDPTRAPFYLSFLLTDASGAEIRTHRKTSFRVPVGVGPGSPAPLGMSISGDGAVNFAVYSKNANAVSLYLYAAAVGGGGGDEPALEIDLDPYIHRTGNVWHVSLASVDGYVSYAFCCGGIRRPLLDPYAKVIGDFVSSNSVYDEGVTAPSMRCFASLAIAPSYNWGRDRHPRLPLEKLVVYRANVALFTKDRSSGLPDDAAGTFTGLSAKVEHFRSLGVNAILLEPVFPFHQVKGPYFPYHFFSPMNLYSSKGLSVSAIKSMKDMVRVMHRNGIEVLLEVVFTHTAEGESECQTISMRGIDNSSYYIANGIAGCKASILNCNHPVTQKLILDSLRHWVLDFHVDGFCFINAPFLVRGPGGEYLSRPPLLEAITFDPVLSMTKIIADPWSPLDISNVQFPFPHWKRWAEVNTRFSIDVRKFLKREALISDLATRLCGSGDLFSTRGPAFSFNHVSRNSGLSLVDLVSFSNDDLLSESSWNCGEEGPSENSAVLQTRLRQIRNFLFILFVSLGVPVLNMGDECGHSAAGSVSYKDRGPLNWRGMKTTFVKEVTGFISFLTALRSRRGDIFQRREFLKLENIHWYGSDLCEPGWDDPTSNFLCMHINAEVDEMAADSVRGDLYICFNANEESVSAALPALAEGSVWLRLVDTSLAFPGFFATESNPKVQQVPGLSSYHVEAHTCVLFESKSALA

SEQ ID NO: 29593 - protein, 556 aa, Zea mays
  misc_feature (98)..(98): Xaa can be any naturally occurring amino acid
  misc_feature (119)..(119): Xaa can be any naturally occurring amino acid
MPPWWGKSSSKEVKKSAKENLIDTFQRLISSNEQKGSRKSRSSRRHGKDTAGDKGCWSTAQSRSTSPSKEVSRCQSFAADRPHAQPLPLPKSRAKVTXTSSDITNSKSTLEKHGKGQLXPLPPIQPKKRPEATEPVTEVATASVSSNCSIDSDDPGDSQLQSPVGNEAENATRITATSSSSVVRKECSSAITRKNTKEVAKPNSAFLSNQILSTSPRGTFADGYQSNLQSPRQIALESAPNSLMSSPSRSPRNICPVQIPTSAFWAIKPHTDVTFLGSGQCSSPGSGQTSGHNSVGGDMLGPIFWQPSRGSPECSPIPSPRMTSPGPSSRVHSGSVSPLHPRAGGVTPESPTNRHAEGNKKQTHRLPLPPLSIANSSTFLPNSSNPTSPISRSPGRTENPPSPGSRWKKGKLIGRGTFGHVYAGFNSDRGEMCAMKEVTLFSDDPKSKESAKQLCQEISLLSRLQHPNIVRYYGSETVDDKLYIYLEYVSGGSIHKLLQEYGQFGEQAICSYTKQILLGLAYLHAKNTVHRDIKGANILVDPNGRVKLADFGMAKH

SEQ ID NO: 29594 - protein, 117 aa, Oryza sativa
  misc_feature (56)..(56): Xaa can be any naturally occurring amino acid
  misc_feature (72)..(72): Xaa can be any naturally occurring amino acid
  misc_feature (88)..(88): Xaa can be any naturally occurring amino acid
  misc_feature (106)..(106): Xaa can be any naturally occurring amino acid
DALPSAANGRKLHIQAPPRVASRFRAPTPPGAVHAADFDSRCNMWRLPIEAIYLIXLGRPANVQIYPEANFXSSLAATASRASAEEVXRDYLSYDEPTTVFPEEAXDDLCGELCKAT

SEQ ID NO: 29595 - protein, 157 aa, Mycoplasma genitalium
MKEIYFGGGCFWGIEKYFQLIKGVKKTSVGYLNSRIRNPSYEQVCSGYTNAVEAVKVEYEEKEISLSELIEALFEVIDPTIRNRQGNDIGTQYRTGIYWTDSSDEKIINDKFLKLQKNYSKPIVTENKKVENYYLAEEYHQDYLKKNPNGYCHIKFD

SEQ ID NO: 29596 - protein, 479 aa, Oryza sativa
MSLRLRLAFRLLFCYCLLLAAAHPSSRRLLPLLVVSAAERTNVASLPGLDGALPSRFETGYVTVDEENGGELFYYFIESEGDPGADPVLLWINGGNRCSVLSALFFEIGPVKLAIEPYDGGVPRLRYNPYTWTKVASVLFVDSPVGAGFSFSRDPRGYDVGDVSSTLQLTKFVNKWFSQHREFLSNPLYVGGESYAGKLVPFLLQKISEDVEAGVKPVLNLKGYLVGNPGTGESIDYESKVPYAHGVGIISDQLYETILEHCGREDYANPKNATCAQALNRFSELMGEVSEAHILYKKCIYVSPKPDDGTIGRKILEEIVVGNHRPPRPPMDCSTYPNYLSYFWANSNNTRENLGIKKGTVDEWVRCHDDGLPYSQDIESSIKYHQNLTSRGYRVLVYSGDHDSVVPFLGTQAWVRSLNYPIVDDWRAWHIDGQSAGFTITYANDLTFATVKGGGHTAPEYQPERCLAMFGRWISEKSL

SEQ ID NO: 29597 - protein, 443 aa, Arabidopsis thaliana
MQRSRRALLVRRRVSETTSNGRNRFYKVSLSLVFLIWGLVFLSTLWISHVDGDKGRSLVDSVEKGEPDDERADETAESVDATSLESTSVHSNPGLSSDVDIAAAGESKGSETILKQLEVDNTIVIVGNVTESKDNVPMKQSEINNNTVPGNDTETTGSKLDQLSRAVPLGLDEFKSRASNSRDKSLSGQVTGVIHRMEPGGKEYNYAAASKGAKVLSSNKEAKGASSIICRDKDKYLRNPCSTEGKFVVIELSEETLVNTIKIANFEHYSSNLKDFEILGTLVYPTDTWVHLGNFTALNMKHEQNFTFADPKWVRYLKLNLLSHYGSEFYCTLSLLEVYGVDAVERMLEDLISIQDKNILKLQEGDTENEKEKVKERLEQVLERLEWMEKKGVVVFTICVGFGTIAVVAVVFGMGIVRAEKQGGLAWLLLLISSTFVMFILSL

SEQ ID NO: 29598 - protein, 375 aa, Streptococcus suis
MAQNKMLAMILAGGRGTRLEGLTKKVAKPAVAFGGKYRIIDFPLSNCANSGIDIVGVLTQYEPVLLNSYVAQSQRWGLDVQGSGVFVLPPSEKIEGFGLYKGTADAITQNIDFIDLHDPEYVLILSGDHIYKMNYDKLLDTHIQKKADATIAVIEVPIKEASRFGIMNTDEDYRIEEFEEKPENPKSNLASMGIYIFTWKTLKKYLQEDDKLDTSSHDFGHDIIPKYLEDGRTLIAHPFRGYWKDVGTVNSLWESNMDLIDHAGDLDLSDRSWRIYSEDKGSPAQVIGATATVKSAYIDKGAVIDGTVEHSVISTDVQVNQNAVVKNSVVLPGAIIGEGVELDYVIVAENIKIADGVKLTGDIDHILLIDKNVTK

SEQ ID NO: 29599 - protein, 429 aa, Solibacter usitatus
MRFSLVNPPWSFTGSIYFGCREPHLPLEYGYARNLLENAGHTVQLVDGQLESLSLDEMRRRVADIRPDFTVVTTAPSYLFWRCAPPELRVPRETIDALRDVGGTMIGVGPHASTTPKTALRKLGADAVVLGECEEVLPRLVGDWRYVDSLCYRRGDAVSVNGGPHASDMTTLSALHWNSELIGRHAHHHHRFDSPQYGAGAEMETSRGCPYHCTFCAKDNFRNRFRRRPLATIAEELDGLIAAGAGYVYFIDEIFLPYRDVLETIRERKIVFGIQTRIDLWNEEMIDLLGDAGCVSIEAGVESITEAGRELLDKKCKIGTEEIGERLIHAKRRVSFVQANLLDSRDDDPADVQKWRQHLQANGVWANEPVPLFPYPGSPDYTRRWGAPDDLAWERAHRSYLEAFDTFSDIQEQRPEPLVQLEIPEGPHA

SEQ ID NO: 29600 - protein, 288 aa, Coccidioides immitis
MEPAQAGAAGGAGAQSAASRQRHHHHQPQDTQGQGGQQGGQQQQQPVIKGASAALSAQGYAPVPELYTGTWANVNQGLTGQARDVLTTYWQHMINHLESDNHDYKIHQLPLARIKKVMKADPEVKMISAEAPILFAKGCDIFITELTMRAWIHAEDNKRRTLQRSDIAAALAKSDMFDFLIDIVPREEATSHTKRSAPSAPPQHANAGQMPPQQPGVQQPHHMGPPDYGSLGQPPMGQEQDYRQQPAMYGGAVQSDPAYGQPQPQMFEGIDDKTRWCLWEKRRYQERE

SEQ ID NO: 29601 - protein, 116 aa, Calonectria gracilipes
TGGKAPRKQLASKAARKSAPSTGGVKKPHRYKPGTVALREIRRYQKSTELLIRKLPFQRLVREIAQDFKSDLRFQSSAIGALQESVESYLVSLFEDTNLCAIHAKRVTIQSNDIQL

SEQ ID NO: 29602 - protein, 511 aa, Oryza sativa
MEWVRGKCVGRGAFGAVHVAVDRATGRAFAVKSVEAKGGAPAAAMACLESEIRILRRLSSPYVVEYLGDDGDAATTRNLHMELVPGGSAAAAAAMGGLGERGARGVVRRVAAALRYLHDVAGVVHGDVKGRNVLVGCDGDGRGAKLADFGAARLVSDAAVSRGPRGTPAWMAPEVARGGAPTPASDVWSLGCTAVELITGKRPWSELGGASEVGELLFLIGFGGKRPELPACASDSCRDFLDKCLRRDAGERWTCDQLLRHPFLSAADVHDGGEPSPFPSPRAVLDWAAASMSDSDSDDSGGAEARSEHEMMARAKGRLVELASNASWGREWGAGPTWEAADTWAPPSSPDTTATNAPVPSNPAAVADAGGPPAVIAGGRDSVLAVATAGAGRDRCDSQHGHYKCELARTRRARLAVASVAAVITTGNHHEQTSSNEYEYIAIPAIGKIRRSMGAYHDLRSAYASMLGVNPDPRNMGTDSMCVTFAGCSSKNAHIQLDNSSPKRRRASHRI

SEQ ID NO: 29603 - protein, 244 aa, Aegilops tauschii
MDAASLMGPSSADAAPDGEHRMGTTIVGVCYDGGVVLAADSRTSTGMYVANRASDKISQLTDNVYVCRSGSAADTQVISDYVRYFLHQHTIQLGQPATVKVASNLVRLLAYQNKSMLQAGMIVGGWDKYEGGQIYSVPLGGTILRQPFAIGGSGSSYLYGLMDHEWKEGMTQEEAEKFVVKVVSLAIARDGASGGVVRTVTINEAGVKRSFHPGDKLPLWHEEMEPQNSLLDILAAGSSDAMVQ

SEQ ID NO: 29604 - protein, 708 aa, Bacteroides thetaiotaomicron
MINPIVKTIELPDGRTITLETGKLAKQADGSVMLRMGNTMLLATVCAAKDAVPGTDFMPLQVEYKEKFAAFGRFPGGFTKREGRASDYEILTCRLVDRALRPLFPDNYHAEVYVNIILFSADGVDMPDALAGLAASAALAVSDIPFNGPISEVRVARIDGQFVINPTFDQLEKADMDLMVAATYDNIMMVEGEMHEVSEAELLEAMKVAHEAIKVHCKAQMELTEEVGKTVKREYNHEVNDEELRKAVREACYDKAYAVAASGNNNKHERFDAFDAIREEFKAQFSEEELEEKAPLIDRYYHDVEKEAMRRSILDEGKRLDGRKTTEIRPIWCEVGPLPGPHGSAIFTRGETQSLTSVTLGTKLDEKIIDNVLEHGKERFLLHYNFPPFSTGEAKAQRGVGRREIGHGHLAWRALKGQIPADYPYVVRVVSEILESNGSSSMATVCAGTLALMDAGVKIKKPVSGIAMGLIKNPGEEKYAVLSDILGDEDHLGDMDFKVTGTRDGITATQMDIKVDGLSYEILERALNQAKEGRMHILDKITETIAEPRADLKDHAPRIETMTIPKEFIGAVIGPGGKIIQGMQEETGAVITIEETDGMGRIEVSGTNKKCIDDAMRMIKAIVAVPEVGEVYKGKVRSIMPYGAFIEFLPGKDGLLHISEIDWKRLETVEEAGIKEGDEIEVKLIDIDPKTGKFKLSRKVLMPRPEKK

SEQ ID NO: 29605 - protein, 699 aa, Oryza sativa
MSPDADAAAAAAAGGEGAAAAGVGTAGEGRGVIRWDQILPRRSLRVLLVEHDDSTRQVVTALLRKCGYRVAAVADGMKAWGVMRERAYAFDLVLTEVTMPTLSGIELLSRIVASDECKNIPVIMMSSQDSIGTVLRCMQKGAVDFLVKPVRKNELRNLWQHVWRRHAMNSQTNASENNAASNHLSANGGNGSKTGEHSDEESDAQSSGSKREVEIQSAEKLPEVVADGGAGSSREHKIQNGFIDGMNTKSHALKGNDDAPSGNACGDSELQVLSTEKNVRSKFLNGITSAKVAGQIMDNALRFADSSSLRSSDPGKDLLVVAQTTADRKCKSSALENNAVMENNLSENSKGTATGHAESCPSHFVEINLEKQHHLNGYTNHKLNEKDIFNHSNSSAFSRYGNKRIESSAQRPFPPSFRVVHQQPVYDKNPQSSRVLLSCEHNTRESTVQAQVPLDRSTEGAAILCSSSVREDAGTSSSSPRKDSLTHPSYGFIPVPIPVGAAIPYHYGAIMQPMYYPQGAFMHCDSAAINKTAIQHVSCQSNYHENLGKPPQIDEHKQPEENHQLHHSRQILRESGEPVDLAKAHMERINQSASCSQDIRKGSGCTGSGETDANTNTVIALESGNESGVQNCSNNVLDGDRSRREAALLKFRMKRKDRCFEKKVRYHSRKKLAEQRPRVKGQFVSQKLKSAITTEAETD

SEQ ID NO: 29606 - protein, 513 aa, Oryza sativa
MAMATALRKLSSDALRRQPLSRITPLYYMASLPATEERSGVTWPKQLNAPLEEVDPEIADIIEHEKARQWKGLELIPSENFTSVSVMQAVGSVMTNKYSEGYPGARYYGGNEYIDMAESLCQKRALEAFRLDPAKWGVNVQPLSGSPANFHVYTALLKPHERIMALDLPHGGHLSHGYQTDTKKISAVSIFFETMPYRLDESTGLIDYDQMEKSAVLFRPKLIVAGASAYARLYDYDRMRKVCDKQKAILLADMAHISGLVAAGVVPSPFDYADVVTTTTHKSLRGPRGAMIFYRKGVKGVNKQGKEVMYDFEDKINAAVFPGLQGGPHNHTITGLAVALKQATTPEYRAYQEQVMSNCAKFAQSLTAKGYELVSGGTDNHLVLVNLKSKGIDGSRVEKVLENVHIAANKNTVPGDVSAMVPGGIRMGTPALTSRGFVEEDFAKVADFFDAAVNLALKVKAAAGGTKLKDFVATLQSDSNIQSEIAKLRHDVEEYAKQFPTIGFEKETMKYKN

SEQ ID NO: 29607 - protein, 514 aa, Unknown
  Candidatus Kuenenia stuttgartiensis
MTISENKNIDIMFIVSPTNAHDVYMPFYFLYLAGYLEKHGYFAEIVNPHEKHIEDNFKAIINEVITRKPKLIGLASFVTDYNVVVGLATEIKKYSDAKIIVGNAHPSIAPEDFLYESSPFDIVVRGEGELTLKQLLEEFSKTGGFNDANGLSHINGIAYFENGAVKITKNRELMDLADCGTPAYHKIDMKWYLKITKHIIRRLATVGAVIYTGRGCPFHCTFCAANSVWSANDKAPGNPVVRKRPLAHVIDELRILQDVYKFDFFYILDDTFGTREKDIIDFCKAYSESGLKMLWAAETRVNCIKDMQIVKLLKESGSIQLDFGVETGSPRLLKAIKKQIVLEDTIQAFDLCRKNGIRTFANMLVNLPGEEAEDLNLTHKLLAEIKPTYTSVGVTQPYPGTEMYINLGKPISNKDYHKLSRLIPPEEFRMSKHKISLRELLFTWQLKYKIEPFFERSLFKTDKTYWLRIINSKNRWSYILFLIKEIVKMPLIHVKIRMRYLKGRKLDKQLERVS

SEQ ID NO: 29608 - protein, 534 aa, Unknown
  Populus tremula x Populus tremuloides
MESGVRKENNPPSSSFSLQQQPPATNPSPLRKIIVVASIAAGVQFGWALQLPLLTPYVQLLGIPHTWAAFIWLCGPISGMLVQPTVGYYSDRCTSRFGRRRPFIAAGAGFVAISVFLIGYAADIGHLSGDSLTKTAKPRAIAVFVVGFWILDVANNMLQGPCRAFLADLSGKDHKKTRTANAFYSFFMAVGNVLGFASGSYTHLYRIFPFSRTKACDVYCANLKSCFFISIALLLTLTILALSYVREKPWSPEGSSGEGGNEEEKEEEGGEAKESTPAPFFGEIVAALKNLQRPMRILLLVTCLNWIAWFPFLLFDTDWMGREVYGGDSSRNTDQLKMYDRGVRAGALGLLLNSVVLGFTSLGVEVLARGVGGVKRLWGIVNFILAICLAMTILITKVAQSNRRYTTVNGGTHLLPPPSGVKAGALALFAVMGIPQAITYSIPFALASIFSNTSGAGQGLSLGVLNLSIVISQMEVSVAAGSWDALFGGGNLPAFVVRAVAAAASGILAFTMLPSPAPDIPSNKRAATSTLAFI

SEQ ID NO: 29609 - protein, 331 aa, Bradyrhizobium japonicum
MALPDFTMRQLLEAGVHFGHQSHRWNPKMAPFIFGTRNNIHIVDLAQTVPMLHHALQAVSDTVAKGGRILFVGTKRQAQDGVADAAKRCAQYFVNSRWLGGTLTNWKTISASIKRLRHLDDVLAGGEANSYTKKERLTLQRERDKLDRSLGGIKDMGGLPDLIFVIDTNKEDIAIQEAQRLNIPVAAIVDTNSDPKGITYVVPGNDDAGRAISLYCDLIARAAIDGISRAQGDSGIDIGASARPLAEELPAASSSGFQGLAGPRGTADDLKKLPGVSGAIEKKFNDLGIFHFWQLAELDHDTAHTIGEEVGLPSRADAWVAKAKALTAEAE

SEQ ID NO: 29610 - protein, 174 aa, Picrophilus torridus
MIRNTRETEIYVELYKDGGINTGDPVLDHMVKTMFFYANIPVTVNAKFDLRHHLWEDLGITIGLEINRVKKDNIKRYGYSIIPMDDALIICSIDFSRSYLNMHVDFKDEEGFEISLIHEFLNALSRTSNITMHFIKMSGENAHHISECMFKALGFSLRSALEASDRIESTKGSI

SEQ ID NO: 29611 - protein, 549 aa, Neorickettsia sennetsu
MKKILIDSRDGETRLAILRSGLLVGYDCEHTNSLPQKGNIYQGIVFKVDDSLQAAFVEYLPGEYGFLPFSEIPVIYFDLLEEVKANAIAEGKHVNLYKHFNATEVIKKGLVLFVQVTKEKRRTKDVTLTAYVKLPGRYCVLMPFLKDLILSKQIVDEQAVSRLTHFAEEEMANRKCGVVFKPYCADADKKNILGDYCSLLSEWEKVVSQNDKSKAPRLVFREANLVKKFLRDSYDGSVGEVIVNHSDVYQEAKDYIQNSLHFENPNITLYSDTLPVFDKYKVEPQVDGLYEETIYLRNGAYIVINTTEALTAVDVNSGRMKKESNIEETAYKVNMEAVAEIVRHLELRGIAGIVVIDFIDMNNSKYMLNVERALLDAFKRYRSRVQIAPINKFGLIALSKQRTKHNILDSHTVKCPCCEGKGKVLKMEHQVRRVFSAIYTAPRCREVTVTANPELAVAVFNGYRKMLAQAEKVVGGSIVFKIDEKLGLAKGFEIAFHGKDDVEILREDQVLTTVEDQSNEKTVTEGSSVVKVESRRSWLASWIKKLTGL

SEQ ID NO: 29612 - protein, 300 aa, Triticum aestivum
MAGAGRKVAVAAVQFACTDTVADNVAAAERLIREAHKKGANIVLIQELFEGHYFCQAQRMDFFGRAKPYKENPTIMRMQKLAKELDVVIPVSFFEEAGNAHYNSVVIIDADGTDLGLYRKSHIPDGPGYQEKFYFNPGDTGFKAFKTKYATIGVGICWDQWFPETARAMVLQGAEILFYPTAIGSEPQDMNLDSREHWKRVMQGHAGANLVPLVASNRIGKETVETEHGNSTIKFYGNSFIAGPTGEIVKLANDKDEEVLVAEFDLDEIKSTRHGWGIFRDRRPDLYKVLLTLDGKTSSS

SEQ ID NO: 29613 - protein, 484 aa, Unknown
  Candidatus Kuenenia stuttgartiensis
MNVLFIYSLQDSQSTAKPLQSFGQMQFGISYISSFLKKHGHHVKLAVLTRAFDKKKEDFGKKYIEGFNPKLICFTTVTTEYRFIAGVAKYIKDRHKDSYLLIGGPHVSLNPSNILSDAFDALCIGEGEFSTLELVSQLESGITPSGIPNLWIKNGAQIEKNAQRPFLQDLNILPFPDREMWKDWICEQPASITPVLLGRGCPFQCTYCSNHALRKVASGAYVRLRSPDNVIDEIKEITAFDPTRKDIYLEVETMGVNRKWDMELCAKLEGLNASLSHPLNFGVNLRVTSNADIENLFVVFKKSNFKFVNIGLESGSERVRREILKRNYSNEDIIKAVTLARKYGLKVNFYNLMGIPGETVADFNETIRMNRICQPDTQMLSIFYPYPGTDLYALCKDQGLLQEPLSTDMERSKAVLDLPGFPKKQIQKNYIWFNYYVYKGYKPAYKILASVIVYKIHSNHRLNKIYRWLTSITIFKMLKYFLKW

SEQ ID NO: 29614 - protein, 369 aa, Zea mays
MAMQTREQHIRRDKATSNICTAQALLANMAAMYAVYHGPAGLKAIADRVHGLAGTFAHGLKKLGTVTVQDLPFFDTVRVTCSDARAIAKEAVKNEMNLRVVDANTITVAFDETSTLEDVDKLFKVFNNGKSASFTAESIAPEVSSSIPSSLARESPYLTHPVFNMYHTEHELLRYLHKLQSKDLSLCHSMIPLGSCTMKLNATVEMIPVTFPNFANLHPFAPTDQAAGYHEMFDDLGNLLCTITGFDSFSLQPNAGAAGEYAGLMVIRAYHNSRGDHHRDVCIIPVSAHGTNPASAAMVGMKIVAVGTDAKGNINIEELRKAAEAYKDNLAALMVTYPSTHGVYEEGIDEICKIIHENGGQVYMDGANM

SEQ ID NO: 29615 - protein, 417 aa, Pseudomonas syringae
MFSKQDQIQGYDDALLSAMNAEEQRQEDHIELIASENYTSKRVMQAQGSGLTNKYAEGYPGKRYYGGCEHVDKVEQLAIERAKQLFGADYANVQPHSGSQANAAVYLALLQAGDTVLGMSLAHGGHLTHGAKVSFSGKLYNAVQYGIDTTTGLIDYDEVERIAVECQPKMIIAGFSAYSKTLDFPRFREIADKVGAYLFVDMAHVAGLVAAGLYPNPLPYADVVTTTTHKTLRGPRGGLILAKANEELEKKFNSAVFPGGQGGPLMHVIAAKAVCFKEAMEPGFKAYQQQVIDNAQAMAQVFIDRGFDVVSGGTDNHLFLVSLIRQGLTGKDADAALGRAHITVNKNSVPNDPQSPFVTSGLRIGTPAVTTRGFKVTQCVELAGWICDILDNLGDADVEANVASQVAALCADFPVYR

SEQ ID NO: 29616 - protein, 298 aa, Neorickettsia sennetsu
MQSIFDRVTVKNLFEVGAHLGHKTRFWNPKMVSYIYGTSNAKTHIVDLQKTVPMLRTALNAISDVAANSGRVLFVGTKMQACDIIKEEATRCGQYYVNLRWPSGMFTNWNTVSKSVKKLVHYEKLLEQEGDVLSKKERLSINRKRERIEKYLGGVRKMGGLPNIIFVIDPKKEHIAVEEAWKLGIPVVAVVDTNCDPSKITYAIPGNDDSLRCIEYYCSLVADAVLVGIESELQRKQSKELDDKADEKAAKVSHSDGQKKGASIRAGTDKAALQKRKVSPKSEKQDNVDAAKLPENKG

SEQ ID NO: 29617 - protein, 547 aa, Corynebacterium diphtheriae
MSFDVTTTEPWATLSERYTAMKATTLRDLFASNPNRAQELSFEAAGLHVDLSKNLIDAETVAAFTALAKASGMREKIKAMFDGEHINNTEDRAVLHTALRLAVDAELNVDGQDVAADVHEVLGRMRDFATSLRNGSWRGYSNHTIKTIVNIGIGGSDLGPAMATKALRTYATAGINAKFVSNVDPADMHAVLDELDPESTLFVVASKTFTTQETLANAHAAKRWLVAAAGGDESAVAKHFVAVSTNAEKVAEFGIDTKNMFGFWNWVGGRYSVDSAIGLSLMSVIGPMDFMRFLDGFRAMDEHFRTADFESNIPVLMGMLNVFYNDFFGAETHAVLPYSQDLGRFPAYLQQLTMESNGKSVRHDGSAVTTNTGEIYWGEPGTNGQHAFFQLIHQGTKLIPADFIGFARPKEDLPTASGEGSMHDLLMSNFFAQTKVLAFGKTAEEIAAEGVSPELVAHKVMPGNRPTTTIMAEELTPFALGALIALYEHIVFVEGVIWDINSFDQWGVELGKQQANDLAPAVAGEVAVDSGDSSTDALISWYRSHRG

SEQ ID NO: 29618 - protein, 266 aa, Corynebacterium diphtheriae
MAVVTMRELLDAGVHFGHQTRRWNPKMRRFIFTDRNGIYIIDLQQTLTYIDEAYEFVKETVAHGGTILYVGTKKQAQESVKNEAERVGMPYVNHRWLGGMLTNFQTVSKRLHRMKELQAMDAAENGYEGRTKKEVLMLTRERTKLERVLGGIADMTKTPSAMWVVDTNKEHIAVSEAHKLNIPVVAILDTNCDPDVVNFPVPGNDDAIRSIDVLTKVISHAVIEGKKAREERALAAAKEAAGDANKTEVAAKVEATEEVAAEAEAK

SEQ ID NO: 29619 - protein, 652 aa, Blastopirellula marina
MGAAQQTLVVVGNGMVSHALCQRLVADRERLSYSIIVIGEEPRTAYDRVRLTKYFETPDPEVLQLATRQWYEDHGIQLRTGDAVIEIDRDRHEVTCASGDKLGYDRLVMATGSRAWRPDVPGVELDGVYLYRTLDDVDAIRNHALRAKSAAVIGGGLLGLEAAKALHDYGLEVHIIEVAPGLMPRQLDADCGAFLKEKIEQLGCQVHLIKRSTEIIADGHSRVLQFASGDSLSVDMVVISAGIRPRAELAAQAELAIGKRGGIEVDDALRTSDPQIFAIGECAEHRGMVYGLVGPGIAMATTLGDNLLGGSSRFVGADQSARLKLLDIDVTSLGSPLGDSPNITLIAAAGDDYARKILLLGGKAVGAFGVGPWSECERLRTVIDAGGRIWPWQQARFQRTGNVWGSDASVQQWPDGAIICSCKNVTKGAIDLAVASGCASVAEVAHATGASTSCGSCQPLVKQILGSSEVVTRIPGRNSLLSASILTLLGMTTLLLIGQVAAAESVDSFRYQLSLLWRNDLLKQITGYGLLAVMLASTLFTLRKRWPRMTWGEYGYWRAFHAIVGFTTLGGLWLHTGGGLGANLNLWLSLAFIALAITGGLTGAAAALESQFTGDVAIWLRKYRPWINQIHIWILVPLGVFLAFHVTCVYYF

SEQ ID NO: 29620 - protein, 161 aa, Xanthomonas oryzae
MSDLSTFEFTDLEGRTQTMRDYAGKVLLVVNVASKCGFTPQYAGLQALWQRYRERGLVVIGFPCDQFGHQEPGDAAQIRQFCSLDYAVDFPLAEKIEVNGSGAHPLWQWLKHEQRGVLGSEAIKWNFTKFLIGRDGRVLERYAPTTKPEALAADIERALDA

SEQ ID NO: 29621 - protein, 339 aa, Unknown
  Mycobacterium sp. MCS
MSEPVADFSPLRVKRVVRETSDAVSLVLDVPRHCSGRFRYQAGQFLTLRVNLDGQELRRCYSMSSAPVEEELRITVKRDPGGLVSNWLNDTVSEGAEIHAAPPEGRFLLRDTDSEIVAFAGGSGITPIMSLIRTALATSARSIRLFYANRNRGSVIFADDLARLVEHNADRLVLTHHYDDDSGVVTPAAIESFVAGAGDADFYICGPGPFMDTVEGALATRGAPRDRVHLERFQVAQVPAGADASEAQATEEIVIELDRKTTTVPYRSGNTLLQTARTAGLRAPSSCETGSCGTCMAQVVSGSARMLNNDALDDDEVADGWVLTCQSLPTSRSVHVVYE

SEQ ID NO: 29622 - protein, 145 aa, Corynebacterium nephridii
MIIVCASCGAKNRVPEEKLAVHPNCGQCHQALLPLEPIELNEQNFSNFISNSDLPVLIDLWAEWCGPCKMMAPHFAQVAKQNPYVVFAKIDTEANPRLSAAFNVRSIPTLVLMNKTTEVARISGALRTLELQQWLDQQLQQQQGN

SEQ ID NO: 29623 - protein, 178 aa, Erwinia amylovora
  misc_feature (10)..(10): Xaa can be any naturally occurring amino acid
MATEYAMIAXGCFWCTEAVFKQINGVESVESGYIGGHTENPTYKQVCNGDTGHAEAIRIGFDPEKVSFGDLLDISFATHDPTQLNRQGNDIGTQYRSAIFPTSAQQAEEAIAAIARARSEYSDPIVTSIEAGAAWYPAEDCHQDYWAGEGQENRYCLAVIPPKLQKLRKRFAAYAVSE

SEQ ID NO: 29624 - protein, 539 aa, Beta vulgaris
MEGRNVKNGDTNNNKIVGSSLSIEKNPISPPEASSLKKLALVASIAAGVQFGWALQLSLLTPYVQLLGIPHTWAPYIWLCGPISGMIVQPTVGYYSDRCTSKFGRRSPFIAVGATLVGFAVSLIGFAADIGHATGDPNGNVPKPRAIAVFVVGFWILDVANNTLQGPCRALLADMAAGSQAKTRYANAFFSFFMALGNIGGYAAGSYSRLYTVFPFTHTKACDTYCANLKSCFFISITLLIVLTILALSVVRERPFTLDEIQEEENLKNNTGGCARLPFFGQLFGALKDLPKPMLILLLVTCLNWIAWFPFLLFDTDWMGKEVYGGTVGEGKAYDMGVHAGALGLMINSVVLGIMSLGIEKLARLVGGVKRLWGIVNLILAVCLAMTILVTKSAEHYRATHHVPGAIGPPLPPPGFKGGALAIFSVLGIPLAITFSIPFALASIFSASSGSGQGLSLGVLNLAIVVPQMFVSVTSGPWDALFGGGNLPAFVVGAVAATASAILSFTLLPSPHRKPKSEGQWVAIKNKEAVLIFNFLFFI

SEQ ID NO: 29625 - protein, 299 aa, Zea mays
MSGGGGLGSGCSYQKFVHFALEQTRHRSTLVPHPSQEKFRFIKANEDNTVLNALSFSTSKIRLLRSLTIEQKNSVQVLDFAAFSRPEYDLPIFCANAFSSPARSIVVLDLNPLYDTTEHKDYREKYYRALMPLVHKYSELHLLPWGGKITSESLRFFSPIVIWTVFEPSEANHQALYSAFVDYYMVWLEFMDGAVRESSKEKIDRNREAQHKYLTWRAEKDPGYPLLKKLIGESGAKDLVREFLFEGVGSLGTKSFLEYFAEYAQEDGTVNKKRSMAGKSFGTRPWDAHGLFVGDAVDG

SEQ ID NO: 29626 - protein, 306 aa, Unknown
  uncultured bacterium
MEEKYDVIIVGAGAAGLAAGIYTSRARLSTLILNEGAVGGQMVLTNEIANYPGVETTSGYALAGTMKKQAKAFGCKIKSNIRIVAYDLNEKEKRIRLEDGKEFTSRSVILAPGGKPRSLHIPGEETYKGTGISYCATCDGDFFTGKEIAVVGGGNSALEEAVTLTNYASKVTIVHQFDHFQAFQHAIDEATRNPKIEFIMESELREFSGNGVLEEVAVEHLPSGNRSSLKVDGVFIFVGYMPNTKSLKGIVGLNERHEIIVDDRLQTSVPGVFAAGDCIPKRYRQVTTAVADGTVAALSVSEFLRS

SEQ ID NO: 29627 - protein, 363 aa, Brassica napus
  misc_feature (210)..(210): Xaa can be any naturally occurring amino acid
  misc_feature (298)..(298): Xaa can be any naturally occurring amino acid
MSVSTIGFEGYEKRLEVTFFEPSIFLDTQGLGLRALAKSQIDEILQPAECTIVSYLSNDQLDSYVLSESSVFIFPYKIIIKTCGTTKLLLSIEPLLRLAGELSLDVDSMRYTRGSFLCPGGQPFPHRNFSEEVSVLDGHFSKLGLSSVAYLMGKDDETKKWHVYSASSGAKKNNKSNVYTLEMCMTGLDKDKASVFYKNESSSMTDNSGXEKILPQSQVFDFEFEPCGYSMNSVEGDAISTIHVTPEDGFSYASFEAVGYDFTTMDLSLLVSRVLTCFEPKQFSVAIHSSIAQKSYNXGLCVDLEGYGCRETTMESLGDERGIVMYQRFEKLGMYCGSPRSTLKCEWSSNSSCTSEDDKEERI

SEQ ID NO: 29628 - protein, 369 aa, Spinacia oleracea
MTTAVTAAVSFPSTKTTSLSARSSSVISPDKISYKKVPLYYRNVSATGKMGPIRAQIASDVEAPPPAPAKVEKHSKKMEEGITVNKFKPKTPYVGRCLLNTKITGDDAPGETWHMVFSHEGEIPYREGQSVGVIPDGEDKNGKPHKLRLYSIASSALGDFGDAKSVSLCVKRLIYTNDAGETIKGVCSNFLCDLKPGAEVKLTGPVGKEMLMPKDPNATIIMLGTGTGIAPFRSFLWKMFFEKHDDYKFNGLAWLFLGVPTSSSLLYKEEFEKMKEKAPDNFRLDFAVSREQTNEKGEKMYIQTRMAQYAVELWEMLKKDNTYVYMCGLKGMEKGIDDIMVSLAAAEGIDWIEYKRQLKKAEQWNVEVY

SEQ ID NO: 29629 - protein, 408 aa, Sinorhizobium meliloti
MSRIVIVGAGECGARAAFALREKGFDGGITLIGAEPDLPYERPPLSKEGLAAAAPPKYLADAMRYQEARITVLTNAPVARIDRDEKAVELADGRSVAYDRLLLATGAPPRVFPGAPENSERIRMLRTHADALAIRAALAPGRKLAVIGGGFIGLELAATARKLGAEVGVIEGLPRILSRGVPKEIAAIVDERHRREGVKILCGARIATIGHQGDGANILLADGGSIAADLLVVGIGATPNTELAEAAGLAVEDGIPVDETLRTSDPDIFAAGDCCSFPLSHYHGRRVRLEAWRNAQEQGTLVAANLMGAAKLVASVPWFWSDQYELTLQIAGLADDAAVTVRRDLSDDASFLFHLDGEGRLIAASAIGPGNAVARDIRLAEMLIATGSRPDPAALASPETKLKKLLGV

SEQ ID NO: 29630 - protein, 345 aa, Oryza sativa
MRALPMAAGRAAAVAACASPAVPRRSLLLSTAAAALHPEPVRLTRGASAAPKLRASPPDAAQAAAAFGSKEEAFAWAKSDNRRLLHVVYRVGDIDRTIKFYTECLGMKLLRKRDIPEEKYTNAFLGYGAEDNHFVVELTYNYGVDKYDIGAGFGHFGIAVDDVAKTVELIRAKGGKVTREPGPVKGGKTVIAFVEDPDGYKFEILERPGTPEPLCQVMLRVGNLDRAISFYEKACGMELLRKRDNPEYKYTVAMMGYGPEDKNAVLELTYNYGVTEYDKGNAYAQIAIGTDDVYKTAEVVKLFGGQVVREPGPLPGINTKITSILDPDGWKSVFVDNIDFAKELE

SEQ ID NO: 29631 - protein, 340 aa, Methanosarcina acetivorans
MEQLTEPPLFIATILEVNGEIALIRQHGNNQEVLTQIPEECLGKIEPGMRVAVNGAYSIISIVSRAADVRAQVMELINSPGVDYSMIGGLDDVLQEVRESVELPLTEPELFEDLGIEPPSGVLLHGAPGTGKTLIAKAIASQAKATFIRMSGSDLVQKFVGEGSRLVKDIFQLARDKSPSILFIDEIDAVGSMRTYDGTSGSAEVNRTMLQLLAEMDGFDPKGNVKVVAATNRIDLLDPALLRPGRFDRSIEVPLPDEKGRVEILKIHTRKMKLADDVDFEKLAKVLTGKSGAEISVIVKEAGIFVLRRRGKEITMADFMKAYEKVVNVQEPTIPQAMFV

SEQ ID NO: 29632 - protein, 449 aa, Sulfolobus tokodaii
MDMHPWLPNIKYIEEMLKSIGVNSIDDLFIDVPEEIKLKKELDLDYKKPLSEYEIILKLQELQNKNKRLKMPPFLGGGLCPHYVPEVVKFIIKRSEFYTAYTPYQPEISQGLLQALFEYQSLIAELFEMEVVNASLYDWGSALAEAIMMANRINKKKTVLVPKLMNPYHKEVVKTWTYGKGIKLVEIPPNERGTIDVSKLESMINEDDVSAIYIQQPNFYGIFEDEIEYIVDIAKKKKIITIMGVSPLALGLIKPPGEYEIDITVGDGQELGLSLNFGGPLLGILATRWDGQLVRQMPGRIVGLTKDSEGKRGFTLILQTREQFARREKATSNITTNEALMAIAAAVYLSLLGRNGIKELAKEIYIRSHYAKKRLEELGVNTVYNGDFFEEFAVDFRTDYDIIHSRLLEKNIHGGLKLGKTQALFCVTEVHTKSMIDELIESIREVFSG

SEQ ID NO: 29633 - protein, 505 aa, Sulfolobus tokodaii
MSWHQAVWNEPLIFEYKGKGRIGFKIPEEEELKKEISINIPEKLRRKEIDLPELSELEVIRHFIRLSQMSFGVDNGMVPLGSCTMKYNPKIEEEAELLTQNLHPLQDDSTVQGILEVLYYMQKWLAEITGMDLCSLQVPAGAAGELAGVLMIKKYHETKGRGNRDEMLVADTAHGTNPASASMENFKVIYIKSNSEGLVDVDILKEIVSERTAGFMLTNPNTLGLFEENILDIAKYIHSVDAKLYYDGANLNGILGVVRPGDMGFDIVHLNLHKTFAVPHGGGGPGAGAICAKGEMVNFLPYPLVEKKDGKYSLSYIPKYSIGKIATFYGNVGNVVRAYTYILGLGAEGISMIGKMSTLATNYLISQLKNVRGLELIAPYRPRKHEVVFSAKTLAKETGVTANDVAKALLDRGFYAPTIYFPPNVEEALMIEPTETEPKEVLDSFAIAIKEIINTAYSNPKEILDTPKNTSVKRLDQVIANHPSSVTPTYRVKRLREEGKIGSLK

SEQ ID NO: 29634 - protein, 454 aa, Aspergillus oryzae
MSLTESSAIDIARTASLASRRLATLSEADRNGALTALHDALLRNKNSILEANAKDVDMASRAAASGNLSQSILKRLDLSRPGKYDDMLKGILDVRDLQDPIGHVTLRTLLDDGLVLERVSCPIGVLLIIFEARPEVIANIAALSIKSGNAAILKGGKESTESFVAISQVISDAISSTQVPKSSVQLVKTRDVISSLLAQDSLIDLVIPRGSNELVRFVKDNTKIPVLGHADGLCSAYLHFDADPEVAVKVIVDSKTDYPAACNALETLLVHQDALETLFPAIADALISKGVCLRCDIPAKAALMKTLPAVPSHLLQDAIDSDYRTEFLDLILAVKTITTAPPGSSSVETAVAHINSHSSKHTDIILTRSKDIADVFMKGVDSAGVFWNASTRFADGMRYGFGTEVGISTNKIHTRGPVGLDGLTIYKYLIRGDGHRACDYSEGGKRWKHQSLPL

SEQ ID NO: 29635 - protein, 427 aa, Oryza sativa
MEADSGKLFVGGISWETDEDRLREYFSRFGEVEAKKAVPRDDQSITSKNNGSSIGSPGPGRTRKIFVGGLASNVTEVEFRRYFEQFGVITDVVVMYDHNTQRPRGFGFITYDSEDAVDKALHKNFHELNGKMVEVKRAVPKEQSPGPAARSPAGGQNYAMSRVHSFLNGFNQGYNPNPIGGYGMRVDGRYGLLTGARNGFSSFGPGYGMGMNSESGMNANFGANSSFVNNSNGRQIGSFYNGSSNRLGSPIGYVGLNDDSGSLLSSMSRNVWGNENLNYPNNPTNMSSFAPSGTGGQMGITSDGINWGGPTPGHGMGNISSLGLANLGRGAGDSFGLPSGSYGRSNATGTIGEPFSAPPNAYEVNNADTYGSSSIYGDSTWRFTSSEIDMPPFGNDLGNVDPDIKSNIPASYMGNYTVNNNQTSRGQ

SEQ ID NO: 29636 - protein, 405 aa, Unknown
  Vibrio sp. Ex25
MAGVLGMILAGGEGSRLRPLTESRSKPSVPFGGSYRLIDFALNNFVNADLMRIYVLTQFKSQSLFHHLKKGWNINGITDRFIDPIPAQMRTGKRWYEGTADAIYQNLRFMELEEPEQVCIFGSDHIYKMDIKQMLNFHSEKQASLTVSALRMPLKEASQFGVIEVDSEGRMIGFEEKPANPKSIPGDPDYALVSMGNYVFEAQVLFSELVEDADNEASSHDFGKDIIPKMFPRGDVFVYDFSTNKISGEREEVYWRDVGTIDAYWEAHMDLLEKDAPFSLYNRKWPLHTYYPPLPPATFTDSDNGRVQIIDSLVCNGSYVRGSRIEKSVLGFRSNIASACDISECILLGDVKIGEGCVLRRVIVDKDADIAPGTQIGVNLQEDKKHFHVSEEGIVVIPKGARVGY

SEQ ID NO: 29637 - protein, 415 aa, Bacillus licheniformis
MKHLPAQDEQVFSAIQDERKRQQSKIELIASENFVSEAVMEAQGSVLTNKYAEGYPGKRYYGGCEHVDVAEDIARDRAKQIFGAEHVNVQPHSGAQANMAVYFTILEHGDTVLGMNLAHGGHLTHGSPVNFSGVQYNFVEYGVDKETQYIDYEDVREKALKHKPKLIVAGASAYPRTIDFKKFREIADEVGAYVMVDMAHIAGLVAAGLHPNPVPYADFVTTTTHKTLRGPRGGMILCREEFAKQIDKSIFPGIQGGPLMHVIAAKAVSFGEALKDEFKTYAQNVINNAKRLAETLKKEGIELVSGGTDNHLVLVDLRSLGITGKVAENVLDEVGITVNKNAIPYDPEKPFVTSGIRVGTAAVTSRGFDLEAIEEVGAIIALALKNHEDEAKLEEAKQRVEALTNRFPLYTGLDY

SEQ ID NO: 29638 - protein, 523 aa, Arabidopsis thaliana
MVGSNNSLAGLQDHLKLAREYALEGSYDTSVIFFDGAIAQINKHLNTLDDPLARTKWMNVKKAIMEETEVVKQLDAERRAFKEAPTGRRAASPPINTKSSFVFQPLDEYPTSSGGGPMDDPDVWRPPTRDVSSRRPARAGQTGTRKSPQDGAWARGPTTRTGPASRGGRGGATSKSTAGARSSTAGKKGAASKSNKAESMNGDAEDGKSKRGLYEGPDEDLAAMLERDVLDSTPGVRWDDVAGLSEAKRLLEEAVVLPLWMPEYFQGIRRPWKGVLMFGPPGTGKTLLAKAVATECGTTFFNVSSATLASKWRGESERMVRCLFDLARAYAPSTIFIDEIDSLCNSRGGSGEHESSRRVKSELLVQVDGVSNTATNEDGSRKIVMVLAATNFPWDIDEALRRRLEKRIYIPLPDFESRKALININLRTVEVASDVNIEDVARRTEGYSGDDLTNVCRDASMNGMRRKIAGKTRDEIKNMSKDDISNDPVAMCDFEEAIRKVQPSVSSSDIEKHEKWLSEFGSA

SEQ ID NO: 29639 - protein, 1145 aa, Cymodocea nodosa
MAAVEHGPLSYRMFLEEVNGTVTGEVKSESSPQDGIIFVGVSLVLGIASRHVLRGTRVPYTVALLLLGVGLGALEYGTSHGLGKLGSGIRIWANINPDLLLGVFLPALLFESSFAMEVHQIKRCIVQMILLAGPGVLTSTFCLGSLLKLTFPYNWDWKTSLLLGGLLSATDPVAVVALLKDLGASKKLSTIIEGESLMNDGTAIVVYQLFYRMVLGEKFGVGSIIKFLSEVPLGAVAVGLAFGIVSVLWLGFIFNDTIIEITITLAVSYIAFYTSQEAIELSGVLTVMTVGMFYAAAARTAFKGESQESLHHFWEMVAYIANTLIFILSGVVIGESVMRNESNFESDGATWGYLILLYAYVQLSRVAVVAILFPLLRYFGYGLEFKEALILIWAGLRGAVALSLSLSVKRASDSLDSPSLKQEVGTLFVFFTGGIVFLTLIINGSTTQFLLHFLAMDKLSAAKIRILNYTKYEMLNKAIEAFEDLGEDEELGPADWPTVKKYITCLNDLEGEKEHPHTITESENHLHHINLSDTRVRLLNGVQAAYWEMLDEGRITQTTGILLMQSVDEAMDTVSHEPLCDWKALKSYVHFPKYYKFLQMSRIPQRLVTYFTVERLESACYISAAFLRAHRTARRQLHEFIGESEIAAAVINESNAEGEDARNFLEDVRISFPQVLRAVKTKQVTYSVLKHLSEYVQTLEKVGLLEEKEMLHLDDAVQTDLKKLLRNPPLVKMPKVRELLDTHPLLGVLPKQVRVPLENSTKETMKIKGTTLYKEGSKPNGIWLISNGVVKWASKTLSNRQSLHPTFLHGSTLGLYEVLVGKPFICDMITDSLVHCFFIEAEKIVPLLRSDPDIEEFLWQESSIVIAKLLLPPVFEKLSLQEVRGLIAERSRMNIYISGEFIEIPHNSVCILLEGFLKTQDAHKSLIASPAVLLPSNVELSFLSLESSGIAAASFCHRGNSYMAEARARVILFEIGATEPPSPLQRRQSSWMSHSIEPQKLQEHGGLMSWPENLQRARSHQILKDSDHHANNMSTRAMELNIFGSMVEGTHKHHAGVPKTSLDFSKSYHRIPSETSPLPLVSTRSEGESLGKRLGQREKPKLLPPPPKPVTGASESKPAEDNSSDESGAEEEIIVRIDSPSHIDI

SEQ ID NO: 29640 - protein, 424 aa, Candida glabrata
MFSEPVKRIYDSQGAYYFQSSEAIRRLEGAIVKYTDLVESRDVADLELSGVVGGVVKVLDRLDQLVSETPPIPGPRRYGNMACRDWHEKIEREIPGLLEDLISSHFPSELQCVVELRYYLANSFGSATRLDFGTGHELSFLATVAALDMLGASFDGDQVLYIFDRYYSLVHRLILSYTLEPAGSHGVWGLDDHFHLAYILGSSQWCNRKKLAMEPNDLSDPVLVEQYSRTNIFCKTLNFVFTVKSGAFREHSPMLFDISRSVRTWAKVRKGLWKMYKDEVLNKFPVIQHFWFGTGFYPWVDYKNGKPLPNYENSPDIDETNDLKTQAQANMDGTRVVESRFLSPGNETFVRRPQLPQDSGVGTMRSSTPESRLMNVTTRSTRSTAGPGQGRMGPPTSMGIVQTRMPSSTTSQAHASRLMNTPRQ

SEQ ID NO: 29641 - protein, 340 aa, Xanthomonas oryzae
MHHAVGASHLFGVCVMPLFPLFANLQGRAVLVIGGGDVATRKVLALLKAEAHIRLYAHALSPELAVLMQAGRFEQLVGEFDPAWIDDVWLVVAATDDTDLNQRVAAAAGARHRLVNVVDDAELSTYQVPAIVDRDPLVIAISSAGAAPMLARRLRERLERELHASVGTLAALFAQHRERIRQRLPDMNRRRRWFDRVIDGQVPQLLQAGETAAAHAAFATALEAVDSVPARGSVQWVGAGPGDPGLLTLNALRALNLADVLLLASDVPAAVVELARRDAQRQPWPATPADQQATLLELIGAGLHVVILRLGSGDAIPAALAAALHAQGAVSARVPGLPVP

SEQ ID NO: 29642 - protein, 152 aa, Schizosaccharomyces pombe
MSGDILVGEYLFKRLEQLGVKSILGVPGDFNLALLDLIEKVGDEKFRWVGNTNELNGAYAADGYARVNGLSAIVTTFGVGELSAINGVAGSYAEHVPVVHIVGMPSTKVQDTGALLHHTLGDGDFRTFMDMFKKVSAYSIMIDNGNDAAEKI

SEQ ID NO: 29643 - protein, 255 aa, Zea mays
  misc_feature (125)..(125): Xaa can be any naturally occurring amino acid
  misc_feature (232)..(232): Xaa can be any naturally occurring amino acid
MALASTSATAPAAVLKTPFLGARRALANAAAPKPAPRRALLAVAAAAAKKSWIPAFKSDAEFINPPWLDGSLPGDFGFDPLGLGKDPAFLKWYREAELIHGRWAMAAVLGIFVGQAWSGIPWFEXAGADPGAIAPFSFGSLLGTQLLLMGWVESKRWVDFFNPDSQSVEWATPWSRTAENFANFTGDQGYPGGKFFDPLGLAGTVKDGVYVPDVEKLERLKLAEIKHARIAXMLAMLVFYFEAGQGKTPLGALGL

SEQ ID NO: 29644 - protein, 186 aa, Oryza sativa
MDPDAVKSTLSNLAFGNVMAAAARDYQKEIVAKEKAQAASASHDEVDLDELLDDPELEKLHAERIAALKKEVEKREVLKRQGHGEYREITEGDFLGENAPFFVTKLGIKTLPCVILFKKGIAADRLIGFQDLGSKDDFSTRALENILKMKGIIDEKKKDEDDEDDETYMSMNRRVRSSTAQDSDSD

SEQ ID NO: 29645 - protein, 204 aa, Viburnum acerifolium
YKHPVNGRKINWMKAGILESDRVFTVSPYYAEELVSGVDKGVELDNFIRKTGITGIVNGMDTQEWNPATDKYVGVKYDITTVMDAKPLLKEALQAEVGLPVDRNIPLIGFIGRLEEQKGSDILAAAIPKFIEQNVQIVVLGTGKKYMEKQLEQLEILYPDKARGVAKFNVTLAHMIIAGADFMMIPSRFEPCGLIQLHAMRYGT

SEQ ID NO: 29646 - protein, 204 aa, Viburnum carlesii
YNKPVKGRKINWMKAGILESDRVFTVSPYYAKELVSGVDKGVELDNFIRKTGITGIVNGMDTQEWNPSTDKYVGVKYDITTVMDAKPLLKEALQAEVGLPVDKNIPLIGFIGRLEEQKGSDILAAAIPKFIEQNVQIVVLGTGKKYMEKQLEQLEILYPDKARGVAKFNVALAHMIIAGADFMMIPSRFEPCGLIQLHAMRYGT

SEQ ID NO: 29647 - protein, 308 aa, Clostridium pasteurianum
MKEEKQLDLVIIGAGPAGLTAAIYAIRAKLNTLVLENELVGGQIRETYTVENFPGFNVISGADLADKMEEHAASIGVNIDQFSNIEKIKLSDDEKIIETEDVIYKVKALIIATGAKSRRLPIPEEEKLHGKVIHYCELCDGALYQGKDLVVVGGGNSAVEAAIFLTKYARNITIVHQFDYLQAQKYSQDELFKHKNVKIIWDSEIRNIVGENEIEKIVVENVKTKQKTELKADGVFVYIGYEPKTELFKDSININKWGYIETDENMETNIKGVFAAGDVRSKLIRQLTTAVSDGTVAALMAEKYIGGK

SEQ ID NO: 29648 - protein, 204 aa, Viburnum cinnamomifolium
YNKPVKGRKINWMKAGIIESDRVFTVSPYYAEELVSGVDKGVELDNIIRKTGITGIVNGMDTQEWNPATDKYVDVKYDITTVMDAKPLLKEALQAEVGLPVDRNIPLIGFIGRLEEQKGSDILAAAIPKFIERNVQIVVLGTGKKYMEKQLEELEILYPDKARGVAKFNVALAHMIIAGADFMMLPSRFEPCGLIQLHAMRYGT

SEQ ID NO: 29649 - protein, 134 aa, Erwinia amylovora
  misc_feature (6)..(6): Xaa can be any naturally occurring amino acid
  misc_feature (32)..(32): Xaa can be any naturally occurring amino acid
  misc_feature (49)..(49): Xaa can be any naturally occurring amino acid
  misc_feature (59)..(59): Xaa can be any naturally occurring amino acid
  misc_feature (81)..(81): Xaa can be any naturally occurring amino acid
  misc_feature (104)..(104): Xaa can be any naturally occurring amino acid
MSETLXVLNNIRTLRAQAREVSLSELEEMLEXLEAVVNERRDAEAAIAXEIKEKEEELXKYRQMLLEDGIDLSELTSAENXSGKPRAKRAPRPAKYEYTDENGXHKSWTGQGRTPAVIKQALDAGKKLEDFLIK

SEQ ID NO: 29650 - protein, 204 aa, Viburnum clemensae
YDKPVKGRKINWMKAGILESDRVFTVSPYYAKELVSGVDKGVELDNFIRKTGITGIVNGMDTQEWNPATDKYVGVKYDISTVMDAKPLLKEALQAEVGLPVDRNIPLIGFIGRLEEQKGSDILAAAIPKFIEQNVQIVVLGTGKKYMEKQLEQLEILYPDKARGVAKFNVALAHMIIAGADFMMIPSRFEPCGLIQLHAMRYGT

SEQ ID NO: 29651 - protein, 496 aa, Schizosaccharomyces pombe
MIVSWSLKDAVVVVVGSGKNAYRRVNLCLSENSSKIFWFCRSSADGGFDVGHLQLDAKKSDAIEILPISEFDPVRSLTTLGKEETDFLVDAVFVSESNHHEKEILHRTCKRYRIPLNIIDNPSLCSFTLPATWSEPPLQISLSTSSNGCRLAQRLLRHVVSSLPSGMPEAIERFGRVRAITKTPEKKQWINHVSDFWPLEKLVRMTEDDLLAIVSDNFSLPLSSSQSSSLANSYESLSTTLDKPSLTLDPEAFPTHKRGSIALIGSGPGSPDLLTVAARKAIMKADYVLADKLVPEAVLQLIPRHTPLFIARKFPGNADKAQDELHQVAFDALSRGDYVVRLKQGDPYIYGRGGEEYLFFTQHGYVPTVIPGISSALMAPISAGIPVTHRGVADQFLVCTGTGQKGSMPKIPSFVPTQTTVFLMALHRLEILVQALIESGWPRVLPVCIAERVSCPDQRFIFSTLEDVVEEYNKYESLPPGLLITGYSCNTLRNTA

SEQ ID NO: 29652 - protein, 204 aa, Viburnum nervosum
YDKPVKGRKINWMKAGILESDRVFTVSPYYAEELISGVDKGVELDNIIRKTGITGIVNGMDTQEWNPATDKYVGVKYDITTVMDAKPLLKEALQAEVGLPVDRNIPLIGFIGRLEEQKGSDILADAIPKFIEQNVQIVVLGTGKKYMEKQLEELEILYPDKARGVAKFNVALAHMIIAGADFMMIPSRFEPCGLIQLHAMRYGT

SEQ ID NO: 29653 - protein, 417 aa, Shewanella oneidensis
MLKKDMNIADYDPELFNAIQNETLRQEEHIELIASENYTSPRVMQAQGSQLTNKYAEGYPGKRYYGGCEYVDVVETLAIERAKQLFGATYANVQPHSGSQANSAVYMALLKPGDTVLGMNLAHGGHLTHGSPVNFSGRLYNIIPYGIDESGKIDYDEMERLAVEHKPKMMIGGFSAYSGIVDWARMREIADKIGAYLFVDMAHVAGLIAAGVYPNPVPHAHVVTSTTHKTLAGPRGGIILSAADDEELYKKLNSAVFPGGQGGPLMHVIAGKAVAFKEALEPEFKTYQQQVVNNAKAMVEVFLERGYKIVSGGTSNHLMLVDLIGRDLTGKEADAALGSANITVNKNSVPNDPRSPFVTSGVRIGTPAITRRGFKEAEAKQLTGWICDILDDAHNPAVIERVKGQVLALCARFPVYG

SEQ ID NO: 29654 - protein, 737 aa, Pseudoalteromonas tunicata
MLKQPTATISKLAIAVSMLISANAQATNDIKTNQFWWPEQLNLSPLRAHGEESNPMGENFNYKAAFLSLDLNQVKADIEQVLTQSQDWWPADYGHYGPFFIRMAWHAAGTYRVHDGRGGAGGGQQRFDPLNSWPDNANLDKARRLLWPIKQKYGHNLSWADLIALTGNVALESMGFKTFGYAGGREDDWEPDYVYWGPESKFLADERRDKKGKLKGPLAAVEMGLIYVNPEGPHGNPDPIASANDIRMSFGRMAMNDEEIVALIAGGHSFGKAHGAKKAGCLDVAPAAAAIEEQGFGWKNKCGKGNAEDTITSGLEGAWTVTPTRWSINYLQNLFAYNWVQTKSPAGATQWIPENNQAANLVPDAHIEGKRHAPIMFTTDIALKEDPEFNKISQRFLNDPKEFELAFAKAWFKLNHRDMGPRARYLGSEVPKEILLWQDYIPEVNHPLVNEKDITSLKNAILSSGLTVPELVRVAWGSAASYRDTDMRGGANGARIRLAPQNEWAVNNPAEVSKVLAKLEAIQTQFNKKSSKRKISLADIIVLAGASAIEQAAKEAGHTVKVPFTPGRMDASQEMTDVESFKVLEPKADAFRNFYSEQSYFSPAEMLIERADLLNLTVPEMTVLLGGMRALNANTNGAQHGVLTAKPGTLNNDFFVNLLDMSTKWTKSGTEGVYEGHDRKTNQLKWTATPVDLIFGSNSELRSMAEVYAAQGAEKKFVEDFVSAWSKVMKLDRFDLR

SEQ ID NO: 29655 - protein, 231 aa, Arabidopsis thaliana
MDQQDHGQSGAMNYGTNPYQTNPMSTTAATVAGGAAQPGQLAFHQIHQQQQQQQLAQQLQAFWENQFKEIEKTTDFKKHSLPLARIKKIMKADEDVRMISAEAPVVFARACEMFILELTLRSWNHTEENKRRTLQKNDIAAAVTRTDIFDFLVDIVPREDLRDEVLGSIPRGTVPEAAAAGYPYGYLPAGTAPIGNPGMVMGNPGGAYPPNPYMGQPMWQQQAPDQPDQEN

SEQ ID NO: 29656 - protein, 790 aa, Aspergillus oryzae
MDSGSPDDCRRFGVTANILQPFASSRPEYQPFLSAVKNIAKPSNGIMAKQPYIPPLIGWLYDLVLWLFSVLVDLFFREVHPRGSWKIPRKGPVILVAAPHANQFVDSLILMRVMRNEARRRISWLIAEKSFRRKFIGLLARSIGTVPVARAMDNMKPGQGTIYMPDPINQPTLIRGIDTDFEGPGFEKDGTIALPTINGTSHNAAIAEIRGPAELIIKKPFKAKDPLYQLTGRKDITDDGQIIGDALDTDPEFKGSKFKVSPHVDQTAVYEAVFARLNAGGCVGIFPEGGSHDRTNLLPLKAGVALMALGTLADNPDCGLKIVPCGMNYFHAHKFRSRAVIEFGNPIEIPREIVEQFKRGEKREAVGALLDTIYQGLLAVTVTSPDYETLMVIQAARRLYNTKGKKLPLPMVVELNRRLVKGYTHFKDDPRIVHLRKSIAEYNRELRLLGIRDHQVGYARFSFIKVIFTLISRLIKLSLLTIGTLPGLLLFTPVFITTKVISKQKSQEALAASTVKLQGRDVMATWKLLVALAFAPALYAFYTVVFTIWAYHNRIQNTVPEWMPLWLIVPIGMVLFPSITFAALRIGEVGMDILKSLRPLVLSLNPSSANSLVKLRQKRAALAQQVTDAINTLGPELFPDFDAARIVTDPFREINRPADKADGEPAPIPEIRRTTTTDFERGSISQEPLPRNESFHNLANIGFFSTRPSSRSRSRSSSFGGRPGSSGQQLKPLSQLTSSDGFEQVSSKIRDAMRQRGEQRRRRHSEDSNSWDMASSGPGTPYSEESRKDI

SEQ ID NO: 29657 - protein, 354 aa, Arabidopsis thaliana
MSLLSDLVNLNLTDATGKIIAEYIWIGGSGMDIRSKARTLPGPVTDPSKLPKWNYDGSSTGQAAGEDSEVILYPQAIFKDPFRKGNNILVMCDAYTPAGDPIPTNKRHNAAKIFSHPDVAKEEPWYGIEQEYTLMQKDVNWPIGWPVGGYPGPQGPYYCGVGADKAIGRDIVDAHYKACLYAGIGISGINGEVMPGQWEFQVGPVEGISSGDQVWVARYLLERITEISGVIVSFDPKPVPGDWNGAGAHCNYSTKTMRNDGGLEVIKKAIGKLQLKHKEHIAAYGEGNERRLTGKHETADINTFSWGVANRGASVRVGRDTEKEGKGYFEDRRPASNMDPYVVTSMIAETTILG

SEQ ID NO: 29658 - protein, 497 aa, Staphylococcus aureus
MSKVQNESNNVVKRGLKDRHISMIAIGGCIGTGLFVTSGGAIHDAGALGALIGYAIIGIMVFFLMTSLGEMATYLPVSGSFSTYATRFVDPSLGFALGWNYWFNWVVTVAADITIAAQVIQYWTPLQGIPAWAWSALFLVIIFSLNSLSVRVYGESEYWLALIKVVTVIVFIAIGLLTIVGIMGGHVVGFEIFNKGEGPILGGNLGGSLLSILGVFLIAGFSFQGTELIGITAGESENPERAVPKAIKQVFWRILLFYILAIFVIGMLIPYDSSALMGGSDNVATSPFTLVFKNAGFAFAASFMNAVILTSVLSAGNSGMYASTRMLYSMSKDKLAFEAFGKTNKNGVPYMSLLVTAIIVVIIFVLQSLTKGAYEYIVAASGLTGFIAWVGIAVSHYRFRRAFDKQNYDKSKLKYTAKLFPFGPLFAGFLCIVVIIGQDVDFIKTGDFNFSRFLITYMGIPVFLAFFIYHKLRYKTKKIPLEQVDLRQDVSMDEIKG

SEQ ID NO: 29659 - protein, 103 aa, Oryza sativa
MSGRGKGGKGLGKGGAKRHRKVLRDNIQGITKPAIRRLARRGSVKRISGLIYEETRGVLKIFLENVIRDAVTYTEHARRKTVTAMDVVYALKRQGRTLYGFGG

SEQ ID NO: 29660 - protein, 151 aa, Triticum aestivum
LRALSRAQIDSVLDLARCTIVSELSNKDFDSYVLSESSLFIYSQKIVIKTCGTTMLLLTIPRILELAEELCMPLAAVKYSRGMFIFPGAQPAPHRSFSEEVAVSAGSPRSVFHCFEAETVESHPLVKEGKLANLLAWRAEDSLEEGVVLCE

SEQ ID NO: 29661 - protein, 372 aa, Perilla frutescens
MAQAVGVSLTTQAKESTLHPKFIRDEDERPKVAYDQFSSEIPVISLARIDESGDKRAEVCRRIVAACEDWGIFQVVDHGVHPMVVEGMTRLAREFFALPDHEKLRFDMSGGKKGGFIVSSHLQGEVVQDWREIVTYFSYPITARDYSRWPDKPVEWRAVTEGYSQLVMELGCKLLEILSEAMGLERDGLSKACVEMDQKIVVNFYPKCPQPDLTLGLKRHTDPGLITLLLQDQVGGLQATRDAGNTWITVQPIQGAFVVNLGDFAHYLSNGRFKNADHQAVVNSKCSRLSIATFQNPAPDAKVYPLKLREGEKAVMEEAITFSEMYKRKMSNDLELARLKKLANEKKLQEDSKNPKFENKVEPCKVLEEILA

SEQ ID NO: 29662 - protein, 238 aa, Solanum lycopersicum
MADPDTTRTVVGIIGNVISFFLFLSPGPTFVQILKAKSVMEFKPDPYIATVLNCAVWVFYGMPFVHPDSLLVITINGFGLAIELLYVSIFFIYSDWSKRQKIIIALVIEAIFMAILIFVTLTFLHGTKDRSMLIGIVAIVFNIIMYTSPLTVMKKVITTKSVKYMPFYLSLANFANGIVWACYALLKFDPYILIPNGLGSLSGLVQLILFAAFYRTTNWDEDEKEVELSTSKSNKSDV

SEQ ID NO: 29663 - protein, 102 aa, Glycine max
  misc_feature (22)..(22): Xaa can be any naturally occurring amino acid
  misc_feature (90)..(90): Xaa can be any naturally occurring amino acid
  misc_feature (93)..(93): Xaa can be any naturally occurring amino acid
YIRVCLILAVLGCSDSFLSQQXVSVLELISQLVHRRSDWRALHQYADNHLAYQRLAIDDPAYGDQLLYNEDNTCVATVHGEIHTYEELRXTVXNHTFRTGSD

SEQ ID NO: 29664 - protein, 416 aa, Bradyrhizobium japonicum
MKAIIVGGGIGGLTTALMLGSRGIACEVFEQADTIRELGVGINTLPHAMRELAGLGLLQKLDDVAIRTDQLYYLNRHGQEVWREARGIDAGHDVPQFSIHRGRLQGVIHRAVEERLGAEAIHTGCRLGAFTQDEGGVTAFFFDRSGAHIHTARGDILIGADGIHSRVRDTLFPNEGPPCWNGLMLWRGARDWPLFLTGKSMIVAGGLNAKVVIYPIAEGSSPASRLTNWAVLVKVGEGNAPPPRKEDWSRPGRREELMPHVARFSVPYIDVKSLISATPEFYEYPTCDRDPLPYWSSGRVTLLGDAAHPMYPVGSNGASQAILDARCLADALVRAEHPRQALVEYEKKRLPMTADIVRSNRRGGPEGVIDAVEQLAPDGFDNVDNVLSYSQREAIVRGYATKAGFAAVPGLAAVRA

SEQ ID NO: 29665 - protein, 736 aa, Clostridium thermocellum
MKKLIITVIVSAVLLTALIPQLPVFAADYNYGEALQKAIMFYEFQMSGKLPDNIRNNWRGDSCLGDGSDVGLDLTGGWFDAGDHVKFNLPMAYTATMLAWAVYEYKDALQKSGQLGYLMDQIKWASDYFIRCHPEKYVYYYQVGNGDMDHRWWVPAECIDVQAPRPSYKVDLSNPGSTVTAGTAAALAATALVFKGTDPAYAALCIRHAEELFDFAETTMSDKGYTAALNFYTSHSGWYDELSWAGAWIYLADGDETYLEKAEKYVDKWPIESQTTYIAYSWGHCWDDVHYGAALLLAKITNKSLYKEAIERHLDYWTVGFNGQRVRYTPKGLAHLTDWGVLRHATTTAFLACVYSDWSECPREKANIYIDFAKKQADYALGSSGRSYVVGFGVNPPQHPHHRTAHSSWCDSQKVPEYHRHVLYGALVGGPDASDAYVDDIGNYVTNEVACDYNAGFVGLLAKMYEKYGGNPIPNFMAIEEKTNEEIYVEATANSNNGVELKTYLYNKSGWPARVCDKLSFRYFMDLTEYVSAGYNPNDITVSIIYSAAPTAKISKPILYDASKNIYYCEIDLSGTKIFPGSNSDHQKETQFRIQPPAGAPWDNTNDFSYQGIKKNGEVVKEMPVYEDGVLIFGVEPNGTGPATPTPKPSVNPSPSPTPTSDILYGDINLDGKINSSDVTLLKRYIVKSIDVFPTADPERSLIASDVNGDGRVNSTDYSYLKRYVLKIIPTIPGNS

SEQ ID NO: 29666 - protein, 257 aa, Prochlorococcus marinus
MLIQNTIFYSQEWRWAKFIKFLISQLDNYHCVEHKIASDFSYKESSYGSKKSKKNINLFTWGATHQKRINFARAVCINSPNYSVLNFLIIPKTSYNIPFLGVDFVSLPTSHLLVLDFQPSLKVENQFNSELLEQIIKLKKSCHSSLPVAEKMSEDVAKFFSPGLIWSRLAKHQDSDNLIENQLYDSFKEYLNLYLKTLFESEEVGHGLQQELINGQNDYLNYRRDNDPARPMLSSLFGKDFTESLINKVLFSTNKVL

SEQ ID NO: 29667 - protein, 637 aa, Cucumis melo
MMESCDCIDAQWPPDELLVKYQYISDVLIALAYFSIPLELIYFVQKSAFFPYRWVLMQFGAFIVLCGATHFINLWTFSMHSKAVAVVMTVAKVACAIVSCATALMLVHIIPDLLSVKTRELILKNKAEQLDREMGLILTQEETGRHVRMLTHEIRSTLDRDTILKTTLVELGKTLGLEECALWMPSRNGLSLQLSHALNYQIPVGTNIPINLPVVNDVFNSNRAICVPYTCQLARVRTPVGGRYLPPEVVAVRVPLLNLSNFQMNNWPDGSSRSYAIMVLILPTDSARKWRDHELELVDVVADQVAVALSHAAILEESMRARDQLVDQNVALDLARREAETAIHARNDFLAVMNHEMRTPMHAIIALSSLLLETELTPEQRVMIETILKSSNLLATLINDVLDLSRLEDGSLVLDMGSFNLHAIFKEALDLIKPIASVKKLSMALILASDLPICAVGDEKRLMQIILNIVGNGVKFTKEGHVSIIASIAKLDSLRDWRPTEFYPMQSDGQFYLRVQVKDSGCGIPPQDIPHLFTRFTQLQTRSNKTNSGVGLGLALCKRFINLMGGHIWIESEGPDKGTTAMFIVKLGICNANPNDLSVKQVAPIVNHRSADLHGQRPIFRETGQVAFSNSRYQRSL

SEQ ID NO: 29668 - protein, 204 aa, Viburnum cylindricum
YKRPVNGRKINWMKAGILESDRVFTVSPYYAEELVSGVEKGVELDNFIRKTGITGIVNGMDTQEWNPATDKYVGVKYDITTVMDAKPLLKEALQAEVGLPVDRNIPLIGFIGRLEEQKGSDILAAAIPKFIEQNVQIVVLGTGKKYMEKQLEQLEILYPDKARGVAKFNVALAHMIIAGADFMMIPSRFEPCGLIQLHAMRYGT

SEQ ID NO: 29669 - protein, 204 aa, Viburnum davidii
YNKPVKGRKINWMKAGIIESDRVFTVSPYYAEELVSGVDKGVELDNIIRKTGITGIVNGMDTQEWNPTTDKYVDVKYDITTVMDAKPLLKEALQAEVGLPVDRNIPLIGFIGRLEEQKGSDILAAAIPKFIEQNVQIVVLGTGKKYMEKQLEQLEILYPDKARGVAKFNVALAHMIIAGADFMMLPSRFEPCGLIQLHAMRYGT

SEQ ID NO: 29670 - protein, 640 aa, Corynebacterium efficiens
MCGLLGILSANGNAADYVPALQRALPCLHHRGPDEAGTWQDGDLAFGFNRLAIIDIAHSHQPLRWGPEGEPERYAMTFNGEIYNYIELREELTALGYAFETEGDGEPIMVGFHHWGADVVNHLRGMFAIAIWDTVDRSLFLARDQFGIKPLFYATTGVGTVFSSEKKAILEMAEELNLDLSLDRRAIEHYVDLQYVPEPETLHTGIRRLESGCTATIIPGGELVEKRYFTPRFPVKSVPKGREQDLFDRIARVLEDSVEKHMRADVTVGSFLSGGIDSTAIATLAKRHNPNLLTFTTGFEREGYSEVDVAAESAAAIGVEHIVKIVSPEEYANAIPKIMWYLDDPVADPSLVPLYFVAAEARKHVKVVLSGEGADELFGGYTIYREPLSLAPFEKIPTPLRRGLGRLSRVLPEGMKGKSLLERGSMTMEERYYGNARSFNFEQMQRVIPWARREWDHREVTAPIYAQSRDMDPVARMQHLDLFTWMRGDILVKADKINMANSLELRVPFLDKEVFKVAETIPYDLKIANGTTKYALRKAMEQIVPPHVLHRKKLGFPVPMRHWLAGDELFGWAQDTINESQTDEIFNKKAVLEMLNEHRAGVSDHSRRLWTVLAFMVWHGIFVENRIDPQIEQRDYPVEL

SEQ ID NO: 29671 - protein, 486 aa, Vibrio fischeri
MNTEKKLLVSQQIIEDACEWAIMHGVAFRQADNTARHCPFSIAPMSIERDVYQHLLRVTPLITKLIHNVSEDHDFLQSSLSDMAKADPFFGLLMSLHQQLHGDAHNKLVAERQPLLLMRTDFMDDRQHGAKVIEFNGIAAGMGPFGQRAAELHAFMKQQWPNTYHQWIEDASAVPAENQGLEQLAYGIAAAAKSVNAHFGNESKPTFLMVVQKNEDNVYDQHLLEVELQKQGVRTVRRTFEQLRTQLSSGDNKRLLLENVGAVDVVYLRAGYQYEDYFSAELNEPICCHTLSQTRLFIEQHHVAVNATISQQLATSKSMQMLLTMMPESEYSRWGLSIDEASLVKSVLADMKPINTDTIHWFTLNANKSEWVLKNQGEGGGHCVFGDDITQKLNQLDAAEYDAWALMQRLYPHERDTPTVAVRDGEQTLVNDLVSEIGLFTAYYNGKPVTELNGYAGYLIRSKPASENEGGIHSGKGILDSLVLVD

SEQ ID NO: 29672 - protein, 447 aa, Erwinia carotovora
MAQIVSLASFLDSVQQRDPHQPEFLQAVNEVLSTLWPFLEQNPHYADYSLLERLVEPERVIQFRVAWTDDKGQVQVNRAWRVQFSSAIGPYKGGMRFHPSVNLSILKFLGFEQTFKNALTTLPMGGGKGGSDFNPKGKSQGEVMRFCQALMTELYRHLGADTDVPAGDIGVGGREVGFMTGMMKKLTNNTACVFTGKGLSFGGSLIRPEATGYGLIYFTEAMLKRHGLGFEGMRVAVSGSGNVAQYAIEKAMELGARVVTVSDSNGTVVDENGFTPEKLALLEEIKNKRYGRVEDYAREAKLTYLAGKTPWEVPVDIALPCATQNELDLPAAQTLIANGVKAVAEGANMPTTIPATDAFLDAGVLFAPGKAANAGGVATSGLEMAQNAARLGWKAEKVDARLHHIMLDIHTACVQYGGEDSQTNYVRGANVAGFVKVADAMLAQGVV

SEQ ID NO: 29673 - protein, 204 aa, Viburnum dilatatum
YKHPVKGRKINWMKAGILESDRVFTVSPYYAEELVSGVDKGVELDNFIRKTGITGIVNGMDTQEWNPATDKYVGVKYDITTVMDAKPLLKEALQAEVGLPVDRNIPLIGFIGRLEEQKGSDILAAAIPKFIEQNVQIVVLGTGKKYMEKQLEQLEILYPDKARAVAKFNVALAHMIIAGADFMMIPSRFEPCGLIQLHAMRYGT

SEQ ID NO: 29674 - protein, 204 aa, Viburnum edule
YSKPVNGRKINWMKAGILESDKVFTVSPYYAEELVSGVEKGVELDNFIRKTGITGIVNGMDTQEWNPATDKYVDVKYDITTVMDAKPLLKEALQAEVGLPVDRNIPLIGFIGRLEEQKGSDILAAAIPKFIEQNVQIVVLGTGKKYMEKQLEQLEILYPDKARGVAKFNVALAHMIIAGADFMMIPSRFEPCGLIQLHAMRYGT

SEQ ID NO: 29675 - protein, 998 aa, Lactococcus lactis
MAMMTMIDVLERKDWENPVVSNWNRLPMHTPMDFLEKQSLNGLWNFDHFSRISDVPKNWLELTESKTEIIVPSNWQIEFKDKSDVPIYTNVTYPIPIQPPYVPEANPVGAYSRYFDITKEWLESGHVHLTFEGVGSAFHFWLNGEYGGYSEDSRLPAEFDISNLAKEGQNCLKVLVFRWSKGTYFEDQDMWRMSGIFRSVNLQWLPDNYLLDFSIKTDLDEDLDFANVKLQAYAKNMDDACLEFKLYDDEQLIGECHGFDAEIGVVNPKLWSDEIPYLYRLELTLMDRSGAVFHKETKKIGIRKIAIEKGQLKINGKALLVRGVNKHEFTPEHGYVVSEEVMIKDIKLMKEHNFNAVRCSHYPNDSRWYELCDEYGLYVMDEANIETHGMTPMNRLTNDPTYLPLMSERVTRMVMRDRNHPSIIIWSLGNESGYGSNHQALYDWCKSFDSSRPVHYEGGDDASRGATDATDIICPMYARVDSPSINAPYSLKTWMGVAGENRPLILCEYAHDMGNSLGGFGKYWQAFREIDRLQGGFIWDWVDQGLLKDGNYAYGGDFGDKPNDRQFSLNGLVFPNRQAKPALREAKYWQQYYQFELEKTPLGQVFAFTVTNEYLFRSTDNEKLCYQLTNGLEVLWENELILNMPAGGSMRIDLSELPIDGTDNLFLNIQVKTIEKYNLLESDFEVAHQQFVLQEKINFTDKIDSNEEITLLEDEELLTVRSAKQKFIFNKSNGNLSRWLDEKGNEKLLHELSEQFTRAPLDNDIGVSEVEHIDPNAWLERWKAVGFYELKTLLKNMIIQATENEVIISVQTDYEAKGKIAFSTIREYHIFRNGELLLKVDFKRNIEFPEPARIGLSLQLAEKAENVTYFGLGPDENYPDRRGASLFGQWNLRITDMTTPYIFPSENGLRMETRELNYGRLKVRAMGQSFAFNLSPYSQNQLAKKGHWHLLEEEAGTWLNIDGFHMGVGGDDSWSPSVAQEYLLTKGNYHYEVSFKLT

SEQ ID NO: 29676 - protein, 204 aa, Viburnum elatum
YNKPVKGRKINWMKAGILESDRVFTVSPYYAEELISGVDKGVELDNFIRKTGITGIVNGMDTQEWNPSTDKYVGVKYDITTVMDAKPLLKEALQAEVGLPVDRNIPLIGFIGRLEEQKGSDILAAAIPKFIEQNVQIVVLGTGKKYMEKQLEQLEILYPDKARGVAKFNVDLAHMIIAGADFMMIPSRFEPCGLIQLHAMRYGT

SEQ ID NO: 29677 - protein, 305 aa, Arabidopsis thaliana
MADRIKGPWSPEEDEQLRRLVVKYGPRNWTVISKSIPGRSGKSCRLRWCNQLSPQVEHRPFSAEEDETIARAHAQFGNKWATIARLLNGRTDNAVKNHWNSTLKRKCGGYDHRGYDGSEDHRPVKRSVSAGSPPVVTGLYMSPGSPTGSDVSDSSTIPILPSVELFKPVPRPGAVVLPLPIETSSFSDDPPTSLSLSLPGADVSEESNRSHESTNINNTTSSRHNHNNTVSFMPFSGGFRGAIEEMGKSFPGNGGEFMAVVQEMIKAEVRSYMTEMQRNNGGGFVGGFIDNGMIPMSQIGVGRIE

SEQ ID NO: 29678 - protein, 90 aa, Burkholderia xenovorans
MAKEELLELDGIVDEVLPDSRYRVTLDNGVVVGAYASGRMRKNHIRILAGDRVTLELSVYDLTKGRINFRHKDERATGGGGARNSQFRRR

SEQ ID NO: 29679 - protein, 326 aa, Zea mays
  misc_feature (80)..(80): Xaa can be any naturally occurring amino acid
MLNPVPYFSQLLFKPCQGFYSLVDGTRSHNPYQGRFRLPAHLFGFLTGQGGAQLANYCRERLYVALLEQLSRIEETAVCXANLGDMVFKKQWEKAFVDSYARVDDEVGGNTMRGGGEEAGTSDAAMTLVPEPVAPETVGSTAVVAVICSSHIIVSNCGDSRAVLCRGKQPVPLSVDHKPNREDEYARIEAEGGKVIQWNGYRVFGVLAMSRSIGDRYLKPWIIPVPEVTIVPRAKDDECLILASDGLWDVMSNEEVCEIARKRILLWHKKNSTSSSSAPRVGDSADSAAQAAAECLSKLALQKGSKDNITVVVVDLKAQRKFKSKT

SEQ ID NO: 29680 - protein, 202 aa, Mycobacterium tuberculosis
MHVTQSSSAITPGQTAELYPGDIKSVLLTAEQIQARIAELGEQIGNDYRELSATTGQDLLLITVLKGAVLFVTDLARAIPVPTQFEFMAVSSYGSSTSSSGVVRILKDLDRDIHGRDVLIVEDVVDSGLTLSWLSRNLTSRNPRSLRVCTLLRKPDAVHANVEIAYVGFDIPKTFVVGYGLDYDERYRDLSYIGTLDPRVYQ

SEQ ID NO: 29681 - protein, 304 aa, Arabidopsis thaliana
MADRVKGPWSQEEDEQLRRMVEKYGPRNWSAISKSIPGRSGKSCRLRWCNQLSPEVEHRPFSPEEDETIVTARAQFGNKWATIARLLNGRTDNAVKNHWNSTLKRKCSGGVAVTTVTETEEDQDRPKKRRSVSFDPAFAPVDTGLYMSPESPNGIDVSDSSTIPSPSSPVAQLFKPMPISGGFTVVPQPLPVEMSSSSEDPPTSLSLSLPGAENTSSSHNNNNNALMFPRFESQMKINVEERGGGGEGRRGEFMTVVQEMIKAEVRSYMAEMQKTSGGFVVGGLYESGGNGGFRDCGVITPKVE

SEQ ID NO: 29682 - protein, 482 aa, Corynebacterium glutamicum
MNANARVFILNSLAMNDPQRSPTLLWFRDDLRLSDNAALKWAADHGPVIGLFIDETINRSIGAAARWWREQSLNALAQDLSFYGVPLLRRTGNPLEILPKIVSEMEVKAVTWNRRYHQPLCEVDATLKKNLRDKGIEVHSHPGFLLTEPWEVSTATGTPYKVFTPFSKAAWEVARVHAYETVKNNVPVPSHLTGPEDVELPILEMEQPFWSTTLVKECAPGEKNASEKLFDFLEHLQDYPQARDSLARSATSKLSAHLRFGEISIHRVWAETAAIDSEGTELFLKELLWRDFAWHRLYALPHMDTQNVRMQFNRFGWSWDPSEKDKLNTPSTPLIPTKADQFHEDLAAWRAGKTGIPLVDAGMRELWATGSMHNRVRMVVASFLTKNLQIHWRHGEEWFWETLVDADPASNAFNWQWAAGSGDDASPYFRIFNPVTQAKKFDPDETYIRRWVPEYGTPSYPDPIVDLKESRQIALDAYSAIK

SEQ ID NO: 29683 - protein, 1550 aa, Unknown
  Nostoc sp. PCC 7120
MKAQLPDNEVQRIAALLEYKILDTPPEAAFDDITRLASYICGTPIALISLIDQNRQWFKATFGLERRETPRDEAFCAHTILESEAFIVPDATADERFATNPLVISDPKIRFYAGVPLTNPEGYSLGTLCVIDYIPRNLSFEQIEALQILGRQVIKQLELRRNLANLVLVNNQHKQAQKIRHPFFKKIAGGFGLASVFLVLLGLASYQAEIELIHNGNQVQTTQESINNLEQLLSQMKDAETGQRGYILTGKDPYLQTYQTALANIDQKFDELRNATVDPVRQQRLVILKPLITAKITELNQTIKLRQNLGFQAALQVIQSDQGQTLMDDIRKVMREMETENKVRLQQQLQAVKASEQKVIFILAIAIVSGFIILAVVYYLIYCEVIARQSMENILNEERNFISAVLDTVSALVIVLDSQGRIVRFNQACEVITGYSFDEVRGRHFWNLFLLPEDVESSKEFFAKFPADPTVPSVQESENYWVTKDGSRRLIAWSRTILQNHEGSVEYIIGTGIDITERKRADKHLTIQYAITRVLAESTTITEATPQILQAICETLGWNVCEIWMVNQQANFLSFFDLWHHTSLEMQEFRTQSQPITFASGIGLPGRIWASGQPIWLTDIVNDGSFLRNQLAAQVGLRGAFGFPIRSGQKILGVITCFSHQVQPHDPDLAKIMDSIGEQVGQFIHRKQAEEELQRQNLRSQLFTEITLKIRQSLQIEEILQITVKEVQKILQTDRVLIYQLLPDGSGSLIIEAVVAGWAAIKGQNITDFYLQTEYQQQYCLQQYRLRHLEAIANLDLGEIQQSHLELLRKFGVKANLVIPILVKDELCGLLIVHQCATSRQWTSFETHLLRQIADQVGIAVAQAQLLEVETRQRQELEVARSQAELASHAKSAFLANMSHEIRTPMNAVLGMTGLMLETLLNQEQRDFMETIRISGDALLTLINEILDLSKLEAGEMALENLNFNLSTCVEEVLDLLAPQAHSKGLEIAALIYRHVPIQLQGDASRLRQILMNLIGNAIKFTSFGEVVMRVELRSETPTTAIIHFAVTDSGLGITLEDQHKLFTPFTQVDASTTRKYGGTGLGLAICKQLVTLMGGEIGVESQLGKGSKFWFEIPFAKQLQPVSFVEDCGLLNNRRLLVVDDHATNRKIIYHQVSRWGMQVDQADRAVAALSMIVEACQQNKPYDVILIDMQMPEMDGMALGKQIKANSAIPPTPLIMLTSTNQRDEVQQAIKIGFAAYLVKPVKSSRLLDTIMSVLKTPSQLEAEKLEVKSQELEKNNLDHSRNHNFTATQAQNSVSTKTRILLAEDNLVNQKVALKQLQSLGYTADVAANGKEVLQLLKQIPYDLILMDCQMPILDGLEATKEIHRWAESSFASCRRPVIIAMTANAMKEDKQMCLDAGMDDYLSKPVMKEQLATALEYWCQLILNSRQAVEFDLNSLPLDWEHLHQLSENDTEFELHLLQIFVEDVRARLELAKEAIANTDFQQMAQQVHQLKGASTNIGATAMYLAAEKLEQLAQNQERRGSMELITEIEEGVNQIQAFLTRSQIV

SEQ ID NO: 29684 - protein, 365 aa, Zea mays
  misc_feature (257)..(257): Xaa can be any naturally occurring amino acid
ACEKLWQRAWRRARGGGERLHRAGVPREKLPFYISRDVYEASIDFFLPDPRITSAYALQVQLHADEETYRSMGKEHALVISNHRSDIDWLIGWILAQRSGCLGSTLAVMKKSSKFLPVIGWSMWFAEYLFLERSWAKDEKTLKWGLQRLKDFPRPFWLALFVEGTRFTPAKLLAAQEYAASQGLPAPRNVLIPRTKGFVSAVSIMRDFVPAIYDTTVIVPKDSPQPTMLRILKGQSSVIHVRMKRHAMSEMPKSDDXVSKWCKDIFVTKDALLDKHLATGTFDEEIRPIGRPVKSLLVTLFWSCLLLFGAIEFFKWTQLLSTWRGVAFTAAGMALVTGVMHVFVMFSQAERSSSAKAARNRVKKE

SEQ ID NO: 29685 - protein, 135 aa, Brassica napus
MGEVVEIMFGNGFPEIHKDTSPIQTLHSNQQECHWYEETIDDDLKWSFALNSVLHKGTSEYQDIALLDTKRFGKVLVIDGKMQSAERDEFIYHECLIHPALLCHPNPKTVFIMGGGEGSAARQILKHKTIEKVVM

SEQ ID NO: 29686 - protein, 321 aa, Anaplasma phagocytophilum
MSEVHKDAVKVLILGSGAAGCTAAIYAGRANLNPVLVTGMQPGGQLTITTDVENYPGFSAIEGPKLMEYMQEQAVKSGATLLTDEISEIDASVYPFKCTSMFGETLQAYSIIVATGAQAKWLGLESEQNFKSKGVSACATCDGAFFKDEVVAVIGGGNTAVEEALYLTRSSKKVFLIHRRDKLRAEAVMQQRLFSNSKIEVIWNSVVKEILGDSEGKKVTSLLLQSTVDSTESLLDVGGVFVAIGHTPNTQVLKNMLGAKVNLDDEGYVITAPGTTITSCPGIFAAGDVCDKVYRQAVVAAGSGCMAALDAEKYLAEKGIE

SEQ ID NO: 29687 - protein, 507 aa, Prochlorococcus marinus
MISLAVSTVSDSPSTVSATSIDRPGGFDRDDWASGYCNVEQELNAVSLRPLRGQIPAELQGSHYRNGPGRFERDGQWVHHPFDGDGMITAVRFSDSKATLSNRFVRTKYWQEEEKAGRFLYRGVFGTQKRGGAKANAFDVRFKNIANTQVVQLGDQLLALWEAAGPHALDPVSLETHGLSSLNGVLKPGEAFSAHPRFDPGHHGEPRMVTFGVNTGPTSKVRLMEFATQGPDAGRLISDRTDSFKGFAFLHDFAITPNWTLFLQNAINFNPLPFVLGQKGAAQCLTSKPGGQAKFWLIPRDCGTFAGQPPRIFDAPDGFVFHHLNAWEEGDELVLESIYYNDYPSIDPGEDFLSMDFDFFPEGRLEQCRINLLGKGIETKRFSERCCEFAMVNPRREGLSARYAWMAVAERETGYAPLQAIKKLDLSNGDQCLWSAAPRGFVSEPLMVPRPGSEAEDDGWLLVFVWNGERRASQLLILNANDLSEQAVLEMPITIPYGLHGSWVAAD

SEQ ID NO: 29688 - protein, 209 aa, Prochlorococcus marinus
MGIMTSLRQGDVHRVTAETDVLVRVGLDGCGQCNVSTGVAFLDHMLHQLSSHGLLDLEITATGDTHIDDHHTNEDVGIAVGQALSQALGDRRGIHRFGHFVAPLDEALVQVVLDCSGRPHFSYGLQIPSQRIGSYDSELVKEFFVAVVNNSGLTLHIRQLAGTNSHHIVEACFKAFARALRMAIEIDPRRAGAVPSSKGVLEQAGGQKS

SEQ ID NO: 29689 - protein, 72 aa, Ralstonia metallidurans
MAKDDVIQMQGEVLENLPNATFRVKLENGHIVLGHISGKMRMNYIRILPGDKVTVELTPYDLSRARIVFRTK

SEQ ID NO: 29690 - protein, 420 aa, Bordetella bronchiseptica
MDEIQSIVIVGAGQAGAVAAASLRQLGYRGGLTLIGQEAHPPYERPPLSKAVLQGTATHAEAAVHPAGFYAENDIALLTETAVAALDPIARTVRLADGRTLPYDRCLLATGGHARELPALPRGRAGVHYIRTLNDALDLRAALRPGVRAAVIGGGFLGLEVASTARELGAEVTVIENGSRLLERALPAIVSDWLAERVRASGVDLRLGGAIAAIGDGPPYAITLADGTQVNADLIVVSIGLAPEVTLARQAGLPLDDNGGICVDAQARTADPHVYAAGDCASQPRACLGTAARFESWQNANEQARAAAAAMLGLAPAAEPYPWFWTDQYGCNIQILGLPQPGLRYVCRPQTDPQAAPRVLWIGLRDGVPCHGIAVNAGGDLRQLRVLFERGIPVDPHRLADPAEALKPLVKAWQAAVAVA

SEQ ID NO: 29691 - protein, 536 aa, Arabidopsis thaliana
MNAAVFSPSALSLPISFSKTRSSFLSRKKGVKGEFRVFAVFGDESGLVEKKSQWRPLFDVEDPRSKAPPYKGKFLDVNQAIEVARFDIQYLDWRARQDLLTIMILHDKVVDVLNRLAREYKSIGTVKKELAGLQEELSKAHQQVHISEARVSTALDKLAHMEELVNDRLLPGRVVTELDKPSSSTTASAVELDREKTNTGAKSLNVSGPVPPYSPHLKNFWYPVAFTADLKHDTMVPIECFEQPWVIFRGEDGKPGCVRNTCAHRACPLDLGTVNEGRIQCPYHGWEYSTDGECKKMPSTKLLKVKIKSLPCLEQEGMIWIWPGDEPPAPILPSLQPPSGFLIHAELVMDLPVEHGLLLDNLLDLAHAPFTHTSTFAKGWSVPSLVKFLTPTSGLQGYWDPYPIDMEFKPPCIVLSTIGISKPGKLEGKSTQQCATHLHQLHVCLPSSKNKTRLLYRMSLDFAPILKNLPFMEHLWRHFAEQVLNEDLRLVLGQQERMLNGANIWNLPVAYDKLGVRYRLWRNAVDRGDDKLPFSG

SEQ ID NO: 29692 - protein, 120 aa, Brassica napus
  misc_feature (4)..(4): Xaa can be any naturally occurring amino acid
  misc_feature (36)..(36): Xaa can be any naturally occurring amino acid
  misc_feature (44)..(45): Xaa can be any naturally occurring amino acid
  misc_feature (57)..(58): Xaa can be any naturally occurring amino acid
  misc_feature (66)..(66): Xaa can be any naturally occurring amino acid
  misc_feature (71)..(71): Xaa can be any naturally occurring amino acid
  misc_feature (78)..(80): Xaa can be any naturally occurring amino acid
  misc_feature (82)..(82): Xaa can be any naturally occurring amino acid
  misc_feature (85)..(85): Xaa can be any naturally occurring amino acid
  misc_feature (90)..(90): Xaa can be any naturally occurring amino acid
MDAXEASATDLKRPREEDDAAAAAASMETENGDQTXEPACFSSXXPGWFSEMSPMWXXEAHSLKVXKVLFXGKSDYQXXXVXQSXTYGKXLFMQQLPKNCALSRTSSSLLCLLFPTPNVP

SEQ ID NO: 29693 - protein, 366 aa, Exiguobacterium sibiricum
MKKRMLTIVSVVALIAIMIGGYFVFQQQQAKSSGSKELTYAKEETAILAGGCFWCMEPPFEELKGVKSVISGYTGGDVKNPTYNQVSAETTGHREAVLITFDPAVISYKQLLDVYWRQIDPTDPNGQFVDQGESYTTAIFYTNAEQKQIAEQSKKNLAESGIFDKKIVTPLIEAGPFYEAEAYHQDYYLKSEKKYKFYRSASERDEFINQYWNDQPKLDVPKYSKLTDDQIKAKLTDIQYKVTQEDGTEPAFDNPYHDLKADGIYVDLISGEPLFSSNDKYDSKTGWPSFSRPLEKGNIIEKSDFALGMKRMEVRSRHGNAHLGHVFNDGPEPTGLRYCMNSAALRFVPKADLEKEGYGQYASEFK

SEQ ID NO: 29694 - protein, 441 aa, Mesembryanthemum crystallinum
MAVAELSPSYKTQLKTCQQLSSSLSTRLSDHRKFSLRLLPRPVSVRGGIRCSVAPNQVQAPVAVPAEGQTGKPECYGIFCLTYDLKAEEETKTWKKMITIAVSGAAGMISNHLLFKLASGEVFGPDQPIALKLLGSERSFNALEGVAMELEDSLYPLLRAVSIGIDPYDIFQDAEWALLIGAKPRGPGMERADLLDINGQIFAEQGKALNAVASRNVKVIVVGNPCNTNALICLKNAPNIPAKNFHGLTRLDENRAKCQLALKAGVFYDKVSNMTIWGNHSTTQVPDFLNAKIDGLPVKTVIKDHKWLEEEFTVMIQKRGGALIQKWGRSSAASTAVSIADAIKSLVTPTPEGDWFSSAVYTNGNPYGIAEDLVFSMPCRSKGDGDYELVKDVVFDDYLRQRIKKSEEELLAEKRCTAHLTGEGVAVCDLPAGDTMLPGEM

SEQ ID NO: 29695 - protein, 441 aa, Pisum sativum
MALTQLNSTCSKPQLHSSSQLSFLSRTRTRTLPRHYHSTFAPLHRTQHARISCSVAPNQVQVPAAQTQDPKGKPDCYGVFCLTYDLKAEEETKSWKKLINIAVSGAAGMISNHLLFKLASGEVFGPDQPIALKLLGSERSIQALEGVAMELEDSLFPLLREVVISIDPYEVFQDAEWALLIGAKPRGPGVERAALLDINGQIFAEQGKALNAVASRNAKVIVVGNPCNTNALICLKNAPNIPAKNFHALTRLDENRAKCQLALKAGVFYDKVSNMTIWGNHSTTQVPDFLNARIDGLPVKEVIKDNKWLEEEFTEKVQKRGGVLIQKWGRSSAASTSVSIVDAIRSLITPTPEGDWFSSGVYTNGNPYGIAEDIVFSMPCRSKGDGDYELVNDVIFDDYLRQKLAKTEAELLAEKKCVAHLTGEGIAVCDLPGDTMLPGEM

SEQ ID NO: 29696 - protein, 173 aa, Vitis vinifera
MARMSDPLIVGRVIGDVVDSFCSTVKMTVTYNSNKQVYNGHELFPSSVTIKPKIEVEGGDMRSFFTLIMTDPDVPGPSDPYLREHLHWIVTDIPGTTDSTFGREIVNYEMPRPNIGIHRFVFLLFKQKRRQTVNPPSSRDRFSTRNFAEENELGPPVAAVFFNAQRETAARKR

SEQ ID NO: 29697 - protein, 204 aa, Viburnum ellipticum
YIKPVKGRKINWMKAGILESDGVFTVSPYYAEELISGVEKGVELDNIIRKTGITGIANGMDTQEWNPATDKYVGVKYDITTVMDAKPLLKEALQAEVGLPVDRNIPLLGFIGRLEEQKGSDILAAAIPKFIEQNVQIVVLGTGKKNMEKQLEQLEILYPDKARGVAKFNVALAHMIIAGADFMLIPSRFEPCGLIQLHAMRYGT

SEQ ID NO: 29698 - protein, 172 aa, Vitis vinifera
MARILEPLIVGRVIGDVLDPFPPTIKMTVTYHNKQICNGYELYPSSITVKPRVEVQGGDLRSFFTLVMTDPDVPGPSDPYLREHLHWIVTDIPGTTDATFGREVLSYEIPKPNIGIHRFVFVLFKQKRRQTVNTPTSRDHFNTRSFAAENDLGLPVAAVFFNAQRETAARRR

SEQ ID NO: 29699 - protein, 204 aa, Viburnum erosum
YKHPVKGRKINWMKAGILESDRVFTVSPYYAEELVSGVDKGVELDNFIRKTGITGIVNGMDTQEWNPATDKYVGVKYDITTVMDAKPLLKEALQAEVGLPVDRNIPLIGFIGRLEEQKGSDILAAAIPKFIEQNVQIVVLGTGKKYMEKQLEQLEILYPDKARGVAKFNVALAHMIIAGADFMMIPSRFEPCGLIQLHAMRYGT

SEQ ID NO: 29700 - protein, 583 aa, Vitis vinifera
EQLRELYESLLEGETDQQSKRPSAALSPEDLSDAEWYYLVCMSFVFNPGEGLPGRALANGQSIWLCDAQYADSKVFSRSLLAKSASIQTVVCFPHMGGVIELGVTELVPEDPSLIQHIKACLLELSKPICSEKSSFVPCNTDDDKDRMCAKVDHDIVETMALEKLYPATEEIKFEQEGMSELHGNIHEEHNIGSPDDCSNGCEDDHQTEDSFMLEGINGGASQVQSWHFVDDDFSNGVQGSMDSSDCISQAFVNQERIHSSPKGENVNNVRLKDLQECNDTKFSSLDLGADDDLHYRRTISTVLRKSHPLIGNSCFRCYDIKSSFITWKKGGMLDAQKPQTQQRILKKILFTVPLMHGGCGFKSQKENAGRDGLWKSGSDGICKQHALSDKKREKEKFLVLRSMVPSINKIDEVSILGDTIEYLKKLEARVEELETSMDLQTELDARARQKYLDMVEQTSDNYDDKMIDDGKKLWINKRKACDIDETDLEINEIIPKDSLPSSDMKVRINEQEVLIEMRCPWREYLLLDIMDAINNLHLDCHSVQSSNHDGFLTLTLKSKFRGRAVASAGMIKQALWRITSKC

SEQ ID NO: 29701 - protein, 192 aa, Vibrio fischeri
MTTKQPTSPPLHFISQRNLEFIPPNFEQIFFGMGCFWGAERLFWQLEGVYSTAVGYSGGVTSHPTYKEVCTGTTNHTEVVKVIFDPTIISLNTLLHSFWQKHDPTEGMRQGNDIGSQYRSAIYTTSKAQQETAKQTQQQYQAALEKQGIMRIITTEIVPLQTFYFAEEYHQQYLAKNPDGYCGLKGTGVCFI

SEQ ID NO: 29702 - protein, 204 aa, Viburnum farreri
YNKPVKGRKINWMKAGILESDRVFTVSPYYAEELISGVDKGVELDNFIRKTGITGIVNGMDTQEWNPATDKYVGVNYDITTVMDAKPLLKEALQAEVGLPVDRNIPLIGFIGRLEEQKGSDILAAAIPKFIEQNVQIVVLGTGKKYMEKQLEQLEILYPDKARGVAKFNVALAHMIIAGADFMMIPSRFEPCGLIQLHAMRYGT

SEQ ID NO: 29703 - protein, 204 aa, Viburnum furcatum
  misc_feature (72)..(72): Xaa can be any naturally occurring amino acid
YNKPVKGRKINWMKAGILESDRVFTVSPYYAEELVSGVDKGVELDNIIRKTGITGIVNGMDTQEWNPATDKXVGVKYDITTVMDAKPLLKEALQAEVGLPVDRNIPLIGFIGRLEEQKGSDILAAAIPKFIEQNVQIVVLGTGKKYMEKQLEQLEILYPDKARGVAKFNVALAHMIIAGADFMMIPSRFEPCGLIQLHAMRYGT

SEQ ID NO: 29704 - protein, 135 aa, Legionella pneumophila
MYFKYIFKEYIMTESLFERLGGQNAVNTAVDIFYRKMLMDDRVNYFFDDVDMEQQILKQKGFLTMVFGGPNQYTGKSMREGHQHLLARGLNDSHVDIVIEHLGETLKELGANEEDIQKVAAIANSVRGDVLGRSS

SEQ ID NO: 29705 - protein, 366 aa, Brassica juncea
LQAVCYVLVRPMSKNTYRKINRVVAETLWLELVWIVDWWAGVKIQVFADDETFNRMGKEHALVVCNHRSDIDWLVGWILAQRSGCLGSALAVMKKSSKFLPVIGWSMWFSEYLFLERNWAKDESTLQSGLQRLNDFPRPFWLALFVEGTRFTEAKLKAAQEYAASSELPVPRNVLIPRTKGFVPAVSNMRSFVPAIYDMTVAIPKTSPPPTMLRLFKGQPSVVHVHIKCHSMKDLPEPEDEIAQWCRDQFVAKDALLDKHIAADTFPGQKEQNIGRPVKSLAVVVSWACLLTLGAMKFLHWSNLFSSWKGIALSAFGLGIITLCMQILIRSSQSERSTPAKVAPAKPKDNHQSGPSSQTEVEEKQK

SEQ ID NO: 29706 - protein, 814 aa, Unknown
  Mesorhizobium sp. BNC1
MTQKLVVVGAGMASGRMLEHLFEAAPGAFDVTLFGAEPRGNYNRIMLSPVLAGEKTYDQIVTHDAEWYAANDVHCRFGETVTKIDRKAKVVFSRSGETPYDKLVVATGSAPFIIPIAGKDLPGVRAFRDLDDVDAMVAAAGRPGAKAVVIGGGLLGLEAAAALRLRGMDVVVLHLMGHLMERQLDPAAGYLLQKELEGRGIKIHCKAQTKAILGDAQVEAVLLEDGTIYPADIVVMAVGIRPEVRIAVDAGLYVERGIVVNDQMVTSDPDILAIGECVEHESICYGLVAPLYEMAKVAAKTLVKQDAAFRPVETATQLKVTGVTLYSAGDFADAEDREEIVLRDASAGVYKRLVLKENRILGAVLYGETSDGAWFFDMLRKGTDVSEMRETLIFGQAYQGGGQLDPMAAVAALPDDAEICGCNGVCKSKITGTIQEKGLTTLDAVRAHTKASASCGTCTGLVEQLMKLTLGDAFNPAAVTPMCGCTDLGHDDVRRLIKASRLKTIPAVMQELEWKTSCGCAKCRPALNYYLVCDWPDEYADDYQSRFINERVHANIQKDGTYSVVPRMWGGVTSAAELRAIADVVDKFNIPTVKVTGGQRIDMLGIKKEDLPEVWADLGKAGFVSGHAYAKGLRTVKTCVGSDWCRFGTQDSTGLGIRIEKFMWGSWTPAKVKMAVSGCPRNCAEATCKDVGVICVDSGFEIHFAGAAGLDIKGTEKLGLVRSEDEALEVIVALTQMYREQARYLERIYKWAKRIGYDEIRRQILDDPEKRKAYYDRFVFSQKFAQVDPWSERASGKDKHEFKPMATLTLEAAE

SEQ ID NO: 29707 - protein, 213 aa, Mycobacterium leprae
MVFRRAAWHALLVAQSFSAINPGPTAELYLGDIKSVMLTQEQIQARIAELGAQIGHDYRDRSPASDQDLLLVTVLKGAVIFVTDLARAIPLPTQFEFMAVSSYGSSMSSSGVVRILKDLDRDIHDRNVLIVEDVVDSGLTLSWLLRNLATRRPQSLQVCTLLRKPDALRANVDITYVGFDIPNDFVVGYGLDYDERYRDLPYIGMLDPRVYQQ

SEQ ID NO: 29708 - protein, 998 aa, Lactococcus lactis
MAMMTMIDVLERKDWENPGVSNWNRLPMHTPMDFLEKQSLNGLWNFDHFSRISDVPKNWLELTESQAEIVVPSNWQIEFKDKNDVPIYTNVTYPIPIQPPYVPEANPVGAYSRYFDITKEWLEGGHVHLTFEGVGSAFHFWLNGEYGGYSEDSRLPAEFDITNLAKEGENCLKVLVFRWSKGTYFEDQDMWRMSGIFRSVNLQWLPENYLLDFSIKTDLDEDLDFANVKLQAYAKKMDDACLEFKLYDDEQLIGECHGFDAEIGVVNPKLWSDEIPYLYRLELTLMDRSGAVFHKETKKIGIRKIAIEKGQLKINGKALLVRGVNKHEFTPEHGYVVSEEVMIKDIKLMKEHNFNAVRCSHYPNDSRWYELCDEYGLYVMDEANIETHGMTPINRLTNDPTYLPLMSERVARMVMRVRNHPSIIIWSLGNESGYGSNHQALYDWCKSFDSSRPVHYEGENDASRLDPDASDIICPMYARVDGPSINAPYSLKTWMGVAGENRPLILCEYAHDMGNSLGGFGKYWQAFREIDRLQGGFIWDWVDQGLLKDGNYAYGGDFGDKPNDRQFSLIGLVFPNRQAKPALREAKYWQQYYQFELEKTPLGLVLAFTVTNEYLFRSTDNEKLCYQLTNGLEVLWENELILNMPAGGAMRIDLSELPIDGTDDLFLNIQVKTIEKCNLLESDFEVAHQQFVLQEKINFTDRIDSSEEITLLEDEELLTVRSAKQKFIFNKSNGNLSRWLDEKGNEKLLHELSDQFTRAPLDNDIGVSEVEHIDPNAWLERWKAVGFYELKTLLKNMIIQATENEVIISVQPDYEAKGKIAFSTIREYHIFRNGELLLKVDFKRNIEFPEPARIGLSLQLAEKAENVTYFGLGPDENYPDRRGASLFGQWNLRITDMTTPYIFPSENGLRMETRELNYGRLKVRAMGQSFAFNLSPYSQNQLAKKGHWHLLEEEAGTWLNIDGFHMGVGGDDSWSPSVAQEYLLTKGNYHYEISFKLT

SEQ ID NO: 29709 - protein, 324 aa, Unknown
  Mesorhizobium sp. BNC1
MTTRHAPVLIIGSGPAGYTAAIYAARAMLKPLLVSGLEQGGQLMITTEVENYPGFAEPIQGPWLMEQMRLQAEHVGTEIVNDLIVEADIRSRPFRLKGDSGTVYTCDALIIATGAKARWLGLPSENTFMGFGLSACATCDGFFYRGKEVVVIGGGNTAVEEALYLSNLAKRVTVIHRRGEFRAERILQERLLRKENVEIMWDTVVDEILGETPKPPLPPSVTGIRVQNVQTGEVRDLPVDGVFVAIGHAPAVELFEGKLKQKPNGYLWTEPNSTRTDVPGVFAAGDVADDVYRQAVTAAGLGCMAALEAERYLAELETHREAAE

SEQ ID NO: 29710 - protein, 355 aa, Glycine max
MSLLSDLINLNLSDITDKVIAEYIWVGGSGMDMRSKARTLPGPVRDPSGLPKWNYDGSSTGQAPGEDSEVIYIHKPFQDPFRRGSNILVMCDAYTPAGEPIPTNKRNNAAKIFGHPDVAAEEPWYGIKQEYTLLQKDVQWPLGWPLGGFLGHKGPYYCGTGANKAFGRDIVDSHYKACIYAGFNISGMNPEVMPGQWEFQVGPSIGISAADELWEARYILERISEIAGVVLSFDPKPIPGDWNGAGAHTNYSTKSMRDDGGYEVIKAAIAKLEKRHKEHIAAYGEGNERRLTGHDETADMNSLLWGVANRGASVRVGRDTEKAGKGYFEDRRPASNMDPYVVTSMIADTTILWKP

SEQ ID NO: 29711 - protein, 942 aa, Unknown
  Mesorhizobium sp. BNC1
MKVDNEQLAEVRTTCPYCGVGCGVIATPQPDGTVAIKGDPDHPANFGRLCSKGSALAETIGLEERLLYPDIHGRRAGWDEALTLVAQRFSDAIKEHGPDSVAFYVSGQLLTEDYYVANKLMKGFIGSANIDTNSRLCMASSVAGHRRAFGADTVPGTYEDLELADLVVLVGSNLAWCHPVLYQRLAAAKDKRPEMKVVLIDPRRTMTADIADLHLAVAPDGDAALFTGLLGYLDITGALSRDYIENHTNGFNEALAVARAFNTERVALESGLAASEVLAFFDLFVGNERTVTVYSQGVNQSVSGTDKVSAIINCHLATGRIGRPGMGPFSVTGQPNAMGGREVGGLANMLAAHMDLENSWHREIVRRFWRAPRLAEKSGFKAVELFRAVADGRIKALWIMATNPADSLPDADFVQAALKACPFVVVSDISAATDTLRHAHVKLPSAGWGEKNGTVTNSERRISRQRPFLPLPGEARPDWWQVVEVARRMGFAEGFAYSTPAEIFREHAALSAYENDGARDFDIGVYAGLSAPAFEALQPFQWPAPSLGSTPLWPAGHLPLKGGNQLSLGPSPIANVADEASELAAGIISPLEGEMAGRPEGGNIRFFADGGFYTPDRRARFIAVFPRVRNVADADFPLVLNTGRVRDHWHTMTRTGQSARLSAHLAEPYAELHPEDAARLGIGDADLVRVESQHGAVIVRALISARQRSGSVFVPMHWTDQFSAKGRVDALVAPITDPISGQPALKNVAVRVSRFEAALYGFAVLQSRPEWDGLDYWALARADGGWRIELAHGALSESPEILLRRLIKSTGKTQILAYHDPKRGDYRLAAFDGERMVGALYLSAHPVAVSRSFAVAQLGSAHPDPCSRYRVVAGRAEADRPEIGAIVCSCFGVGANQIAAAARGGCRTVEAIGRALSAGTNCGSCRGEIRGIVEAHVVEAAE

SEQ ID NO: 29712 - protein, 233 aa, Clostridium acetobutylicum
MSVISMKQLLEAGVHFGHQTRRWNPKMAPYIFTERNGIYIIDLQKTVKKIDEAYNFIREVSEQGKDILFVGTKKQAQEAIAEESVRAGMHFVNNRWLGGMLTNFNTIKTRIAKLNGLKKMEEDGTFDVLPKKEVIILRNEEEKLVKNLGGIVNMTQSNIGALFVVDPRKEKNAISEAKILGIPVVAIVDTNCDPDEVDYVIPGNDDAIRAVRLITSKIADAIIEGRQGEQLAE

SEQ ID NO: 29713 - protein, 717 aa, Triticum aestivum
  misc_feature (361)..(361): Xaa can be any naturally occurring amino acid
  misc_feature (407)..(407): Xaa can be any naturally occurring amino acid
MAGADPNRSFMKDVKRIIIKVGTAVITRNDGRLALGRIGALCEQVKDLNAQGYEVIMVTSGAVGVGRQRLRYRKLVNSSFADLQKPQMELDGKACAAVGQSGLMALYDMLFTQLDVSSSQLLVTDSDFDNSNFRERLRETVESLLELRVIPIFNENDAISTRKAPYEDSSGIFWDNDSLAGLLALELKADLLVLLSDVDGLYSGPPSEPSSKLIHTYIKEKHYHEITFGDKSRVGRGGMTAKVQAAVWASTGGVPVVITSGCASQSLVKVLRGEKIGTLFHKNASLWEPSKETSVREMAVAARDCSRRLQNLSSEERKKILLDVADALEANEDLIRSENEADLAAAHEAGYESALVSRLTXKPGKIASLAKSVRTLANMEDPINEILKRTEVADGLVLEKTSCPLGXVLLIIFESRPDALVQIASLAIRSGNGLLLKGGKEAMRSNAILHKVITNAIPDNVGEKLIGLITTRDEIADLLKHDDVIDLVIPRGSNKLVAQIKSSTKIPVLGHADGVCHVYIDKSADMDMAKRIVMDAKIDYPAACNAMETLLVHKDLMKTPELNDILVALKTAGVNLYCGPVAHKVLGYPKADSLHLEYSSMACTVEIVDDVQSAIDHIHRYGSAHTDCVVTTDDKVAETFLRQVDSAAVLYNASTRFSDGARFGLGAEVGISTGRIHARGPVGVEGLLTTRWLLRGKGQVVNGDKDVEYTHKSLPLQ

SEQ ID NO: 29714 - protein, 524 aa, Corynebacterium diphtheriae
MSTPITHESSSHALAEDAEVHGKNENRRQFTGLFAGLILAVLIYLVFPESSVDMVQGVDPDGEYSYNALRITAAIAVLMGAWWMTEAIPLAATALVPLVAFPVLQVIPFAKISAPYASPTIFLFMGGFILALGMQRWNLHRRLALSVVLLVGTKPKQLIAGFMLATGFLSMWVSNTATAVVMLPIGVSVLQLTAESVGGMKAQKKFATALMLAIAYSASIGSLGTIIGTPPNALMVAYMAENHDIHIGFGTWMLVGVPLAIVYMAIAWLVLVSVFKPEVDSIPGGREMIKSELAKMGSMKFGEAATAVIFTGAALSWVFVPLLIDVFQWKVEIADAAIGLIASMLLFMIPADRKTGVRLTDWKTANELPWDVLLLFGGGLALSKMFSDSGLSLWIGEIAKGLVSLPLILLIAAIAALVLLLTEFTSNTATAATFLPIMAGVAVGIGLNANGDQNILLLTIPVALSATCAFMLPVATPPNAIAYGSGHVRIGDMVKGGVWLNLIGVVLVTLATYFLAIPVFNIVL

SEQ ID NO: 29715 - protein, 499 aa, Corynebacterium glutamicum
MTTTEAIYKRTVIVGSGFAGLGMGAQLKRRGDHDFVIIERADDVGGTWRDNTYPGAACDVPSHLYSFSFHPNPNWSQVFSPGPEIQTYLQNFAQDEGLLPHLHFNRNMNNARWDEKEGRWHITTPGQVYIAQFLITGTGHLADESYPTIPGLESFTGEKFHSARWDHNVSLKGKRIGVVGTGASAIQIVPEMAKIASELVVFQRTPSYIIPRMERKYTDGEKRLFQRNPHVIENLRSELFWGGENTFAQRRAIPRFLAEGKKLALDHLAAQVSDEELRAKLTPSYEPGCKRVLISNTYYPALQSPITTLEASALSSINGSTVRAASGEEYELDILIFATGFEATEPPYAQLIDGCDGLNLSEHWERGMQAYQSVAVAGFPNLLSINGPNTSLGHNSIVYIIESQIEYILGAMDYMSAIGASIIEPTAEAEEAYVEHIQRNAVGTVWLDGGCNSWYVDQRTGRLTLIWPDFGYAFRDANGTFDAEGYEFRDVPATAPATL

SEQ ID NO: 29716 - protein, 425 aa, Mycobacterium bovis
MNTLNDSLTAFDPDIAALIDGELRRQESGLEMIASENYAPLAVMQAQGSVLTNKYAEGYPGRRYYGGCEFVDGVEQLAIDRVKALFGAEYANVQPHSGATANAATMHALLNPGDTILGLSLAHGGHLTHGMRINFSGKLYHATAYEVSKEDYLVDMDAVAEAARTHRPKMIIAGWSAYPRQLDFARFRAIADEVDAVLMVDMAHFAGLVAAGVHPSPVPHAHVVTSTTHKTLGGPRGGIILCNDPAIAKKINSAVFPGQQGGPLGHVIAAKATAFKMAAQPEFAQRQQRCLDGARILAGRLTQPDVAERGIAVLTGGTDVHLVLVDLRDAELDGQQAEDRLAAVDITVNRNAVPFDPRPPMITSGLRIGTPALAARGFSHNDFRAVADLIAAALTATNDDQLGPLRAQVQRLAARYPLYPELHRT

SEQ ID NO: 29717 - protein, 564 aa, Hanseniaspora uvarum
MSEITLGRYVFERIKQVGVNTIFGLPGDFNLSLLDKIYEVEGLRWAASLNELNAAYAADGYSRIKGLGVIITTFGVGELSALNGIAGAYAEHVGVLHIVGVPSLASQAKQLLLHHTLGNGDFDVFHRMSANISETTAMITDLAAAPAEIDRCIRTAYIAQRPVYLGLPANLVDLNVPAKLLETKIDLALKANDAEAENEVVETILALVADAKNPVILSDACASRHNVKAEVKQLIDATQFPAFVTPLGKGSIDEKHPRFGGVYVGTLSSPEVKQSVESADLILSVGALLSDFNTGSFSYSYQTKNIVEFHSDYIKIKNASFPGVQMKFVLEKLIAKVGAKIANYSPVPVPAGLPKNAPVADSTPLAQEWLWNELGEFLEEGDIVVTETGTSAFGINQTRFPTDAYGISQVLWGSIGYSVGAMVGATFAAEELDKAKRVILFVGDGSLQLTVQEIACLIRWGLKPYIFVLNNNGYTIEKLIHGPTAQYNMIQNWKQLRYLTNFGATDYEAIPVKTVGEWKKLTADPAFKKNSTIRLIEVFLPEMDAPSSLVAQANLTAAINAKQD

SEQ ID NO: 29718 - protein, 153 aa, Capsicum annuum
MQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRLRGGF

SEQ ID NO: 29719 - protein, 492 aa, Mycobacterium avium
MTATISTPQYLLDQARRRFTPTLNTIPGMGAIEKRLLAHEWQTKVLAEPPAGSGLKPVLGDAGLPILGHIIELFRGGPDYALFLYRNHGPLIYLDSPIMPAVTALGPDATQAVFSNRNKDYSQKGWHPVIGPFFNRGLMMLDFDEHMYHRRIMQEAFTRSRLTGYVEHIDRVATAIVADWPTNDARFLFHPAMKELTLDIASLVFMGHEPGTDHDLVTTVNQAFTTTTRAGGAIIRQPIPPFKWWRGLRARQLLEDYFSERVKERRNATGNDMLTVLCHTEDDDGNSFTDDDIVNHMIFLMMAAHDTSTSTTTTMVYNMAAHPEWQERAREESARLGDGPLDIEALEKLETLELIMNESLRMVTPLPFNMRQAVRDTELLGHYIPAGTNITIWPGMNHRLPELWTDPDKFDPERFAEPRAEHKKHRYAFAPFGGGAHKCIGMVFGQLEVKTVVHRLLRRYRLELARPGYQPRWDYGGMPIPMDGMPIVLRPL

SEQ ID NO: 29720 - protein, 443 aa, Arabidopsis thaliana
MAMAELSTPKTTSPFLNSSSRLRLSSKLHLSNHFRHLLLPPLHTTTPNSKISCSVSQNSQAPVAVQENGLVKTKKECYGVFCLTYDLKAEEETRSWKKLINIAVSGAAGMISNHLLFKLASGEVFGPDQPIALKLLGSERSIQALEGVAMELEDSLFPLLREVDIGTDPNEVFQDVEWAILIGAKPRGPGMERADLLDINGQIFAEQGKALNKAASPNVKVLVVGNPCNTNALICLKNAPNIPAKNFHALTRLDENRAKCQLALKAGVFYDKVSNMTIWGNHSTTQVPDFLNARINGLPVKEVITDHKWLEEGFTESVQKRGGLLIQKWGRSSAASTAVSIVDAIKSLVTPTPEGDWFSTGVYTDGNPYGIEEGLVFSMPCRSKGDGDYELVKDVEIDDYLRQRIAKSEAELLPEKRCVAHLTGEGIAYCDLGPVDTMLPGEV

SEQ ID NO: 29721 - protein, 617 aa, Medicago truncatula
MASKPGILTNWPWKPLGSFKFVILIPWIGHSIYSFIWVERDPIQYLICPFILVRMLHNQIWISISRYETARGKSKIVDKSLEFEQVDRETNWDDQILFTALLYYIGYMIFPMASNLPWWRIDGVILTAILHAGPVEFLYYWLHRALHHHYLYSRYHSHHHSSIVTEPVTSVAHPFAEHLSYFTLFAIPMLTTLFIKKSSVAALYGYVFFIDFMNNMGHCNFEFFPKKLFSYFPQLKYLSYTPSFHSLHHTKFRRNYSLFMPMYDYIYGTVDKSTDVIYETSLMRPKESPDVVHLTHLTTFNSIYQLRLGFASLASNPQTSKWYLHLMWPFTMFSMLMTWICGRAFVLESNSFKNLKLQCWLIPRFKRQYFSKWQSKTFNNLIEEAIVEAELNGAKVISLGLFNKNHQLNERHEHYIGRLPQLKIKVVDGSSLAAATVLNNIPKGTNQVLLRGKFNKVAFVIANALCKKNVQVVVLYKDELKELEQRINTSKGNLALSPFNTPKIWLVGDEWDEYEQMEAPKGSLFIPFSHFPPKKMRKDCFYHYTPAMITPTTFMNSHSCENWLPRRVMSAWRIAGIIHALEGWNVHECGDTILSTEKVWEASIRHGFQPLKNILTN

SEQ ID NO: 29722 - protein, 389 aa, Vibrio vulnificus
MNDVIRDFFKMESAGGILLVIAAAIAMVIANSPLNESYQAVLHTYVFGMSVSHWINDGLMAIFFLLIGLEVKRELLEGALKSRETAIFPAIAAVGGMLAPALIYVAFNGNDPEAIKGWAIPAATDIAFALGIMALLGKRVPVSLKVFLLALAIIDDLGVVVIIALFYSGDLSTLALTVGFAMTGVLFMLNAKNVTKLIWYIVVGFILWVAVLKSGVHATLAGVVIGFSIPLQGKKGEHSPLKHMEHALHPYVAFAILPVFAFANAGISLEGVSLSGLTSMLPLGIALGLLVGKPLGIFTFSWAAVKFGVAKLPEGVNFKHIFAVSVLCGIGFTMSIFISSLAFGGANPDFDTYSRLGILMGSTTAAVLGYFLLHVSLPKTAAESEKAIS

SEQ ID NO: 29723 - protein, 503 aa, Unknown
  Azoarcus sp. BH72
MSAACVLPLGDNPLPSLPITQCLMTVALVWFRRDLRCVDHAALYHALREHERVYCAFVFDTDILDALPTRADRRVEFIHAAVVELDRALEALSREAGGSGSGLIVRHGRAQEAIPALAQALGVDAVYVNRDYEPAAIARDRAVAERLAEHGRTLRDFKDQVIFDRDEVLTQAGQPFSVFTPYKNAWLRKLDPFYLQAYPIAPRARRLAPKPAGEGVPALGRIGFEPTDLRGLALPTGASGARALFGDFCGRIEDYRIARDFPAVKGVSYLSTHLRFGTIPVRELAAYAVHQGGAGAQTWLSELIWRDFYQMILWHHPRVVDQAFRPEFDRIRWDDAPALFDAWREGRTGYPIVDAGMRQLLRSGYMHNRLRMIVASFLTKDLGVDWRLGERHFAAHLNDYDLAANNGGWQWAASTGCDAQPYFRIFNPVTQSQKFDPEGRFIRRYVPELARVPDRHIHAPWQMDAATQSRACVQIGRDYPAPVVDHALARERTLARFAVTKGG

SEQ ID NO: 29724 - protein, 103 aa, Olisthodiscus luteus
MSGRGKGGKGLGKGGAKRHRRVLRDNIQGITKPAIRRLARRGGVKRISGLIYEETRGVLKVFLENVIRDAVTYTEHARRKTVTAMDVVYALKRQGRTLYGFGG

SEQ ID NO: 29725 - protein, 93 aa, Arabidopsis thaliana
  misc_feature (69)..(69): Xaa can be any naturally occurring amino acid
  misc_feature (80)..(80): Xaa can be any naturally occurring amino acid
MASFTASAYTVYDASPALLIKPTAAISAPVLGMPPMGQTKGGARCSMETKHGNDSPMGAEASAAATAAXTAGMSNPAKAXYDERTPTEGTGSP

SEQ ID NO: 29726 - protein, 237 aa, Brassica napus
MSTSDQDRHHRPPPSRNRQPPRSKASKRVLLRVASVACGIQFGWALQLSLLTPYVQELGIPHAWASVIWLCGPLSGLFVQPLVGHSSDRCKSKYGRRRPFIVAGAAAIAVSVWVIGHAADIGWACGDREGKIKPRAIVAFLWGFGIWDVANNMTQGPCRALLADLTENDNRRTRVANGYFSLFVAMGNILGYATGSYNGWYKVFPFTKTVACNVECANLKSAFYIDVVFIAITTILS

SEQ ID NO: 29727 - protein, 133 aa, Unknown
  Synechococcus sp. RS9916
MRMLHTMLRVGDLERSLRFYTEVLGMQLLRRKDYPSGRFTLAFVGYGPESDHTVLELTHNWDTKDYAIGDGYGHIALGVDDIVGTCQAIAERGGRVVREPGPMKHGNTVIAFVEDPDGYKVELIQLSSRSDAA

SEQ ID NO: 29728 - protein, 339 aa, Escherichia coli; identical to SEQ ID NO: 386

SEQ ID NO: 29729 - protein, 432 aa, Brassica napus
  misc_feature (212)..(212): Xaa can be any naturally occurring amino acid
MKPLCLIIFLSIVIQQSYLKLGADASSRDGFVRTKGVQFSLNGYPYYANGFNAYWLMYVASDPTQRPKISAAFQEASRHGLTVARTWAFSDGGYRPLQYSPGSYNEDMFQGLDFAIAEARRNGIKIILSFANNYVSFGGKKQYVDWARSQGRPVSSEDDFFTDSLVKDFYKNHIKAVLNRFNTFTKVQYKDDPTIMAWELMNEPRCPSDPTXGRTIQAWITEMAAHVKSLDTNHLLEAGLEGFYGQSSPQSKTLNPPGQFGTDFIANTAIPGIDFVTAHSYPDEWFIDASEQFQMEFLNKWLDAHIQDAQNVLRKPIILAEFGKSTKKAGYSPAQRDVVFNTVYTKIYESAKRGGAAAGGLFWQLLGNGMDNFQDGYGIILGQSSSTVNVIAQQSRKLTLIRKIFARMINVEKWKRARGYGPVGKGGHYIPN

SEQ ID NO: 29730 - protein, 236 aa, Chaetosphaeridium globosum
MNSWNINLEDMMEAGVYLGHQARKWNPKMAPYIFAERKGIHIINLTQTARFLTEACDLLFNTAKNGEQFLIVGTKYQAADLVALTAKKSRCHYVNQKWLGGMLTNWTTIKKRLKKLQELESLESINGFDRFPKKEASNLKRQLAQLRKYLGGIRHMTKLPDIVIIIDQQHELTALKECLILGIPTICFVDTDCDPDLTDIPIPANDDSRASIQWILNKLTNSIREGRAFSKNDSIN

SEQ ID NO: 29731 - protein, 166 aa, Aquilegia formosa
MAASVDPLVVGKVIGDVVDMFIPTINMSVYYGSKHVTNGCDIKPSLATAPPTVHISGFSDELYTLVMSDPDAPSPSEPTKREWLHWIVVNIPGAGYVTRGKEVLPYMGPAPPVGIHRYALLLFRQKNPLSIDNPPLRANFKTRNFAHQFDLGLPVACAYFNAQKEL

SEQ ID NO: 29732 - protein, 425 aa, Vibrio fischeri
MSVYNTLCFLAAAAMLIAFFNSKIGKMQTTIAITAGSMMLSLGIIIAGQNNWFNLREVATETLTDINFEDFLLKGILGFLLFAGGLGIKLQNLKDQKWEITVLALGATLFSTFFIGFILWAICNVIGVNLDLIYCLLFGALISPTDPIAVLAIVKKMNAPQRISTQIEGESLFNDGFGLVIFVTLFTIAFGHETPTVGSVTALFFQEAIGGIAYGFILGLVFHYLISSTNDHSMELLLTIGIPTAGYALAEVLHVSGPLAMVVSGIMIGNWTRFIGFSKESEDHLDHFWELVDEFLNGVLFLLIGMSMLLFQFHQEDWILMAISIPLVLTSRYLSVFISYIGFNRFRTYNPLSVRILTWGGLRGGLALAMALAIPAGIMVIPEKNIDVREIILVMTYSVVVFSILVQGSTITPMIDKAKKLEKEM

SEQ ID NO: 29733 - protein, 329 aa, Pyrococcus furiosus
MHPKVQSLLSKFPRVELIPWETPIQYLPNISKLVGADIYVKRDDLTGLGIGGNKIRKLEYLLGDAIIRKADVIITVGAVHSNHAFVTGLAAKKLGFDVVLVLRGKEELRGNYLLDKIMGIETRVYEAKDSFELMKYAEEVAKELEEKGRKPYIIPVGGASPVGTLGYVRASGEIAEQGNRIGVNFDSIVVATGSGGTLAGLSVGLAILRKETRAIGMAVGKFGETMVNKVEELAKATGEFIGVKNLKLKIELYDYSFGEYGKITREVAETIRLVGTKEGVILDPVYTGKAFYGLLDLAKKGELGEKILFIHTGGISGTFHYGDKILSFL

SEQ ID NO: 29734 - protein, 204 aa, Viburnum kansuense
YKLPVNGRKINWMKAGILESDRVFTVSPYYAEELVSGVDKGVELDNFIRKTGITGIVNGMDTQEWNPATDKYVGVKYDITTVMDAKPLLKEALQAEVGLPVDRNIPLIGFIGRLEEQKGSDILAAAIPKFIEQNVQIVVLGTGKKYMEKQLEQLEILYPDKARGVAKFNVALAHMIIAGADFMMIPSRFEPCGLIQLHAMRYGT

SEQ ID NO: 29735 - protein, 333 aa, Idiomarina loihiensis
MQTPQVTVLGAGSYGTALAICFARKGIPTTLWGRDADKVAVMQTAHENEEYLPACPFPESLKVTADLGEALKDVKNVVVVVPSHSFSSMLKQAKPLLAEHARVAWATKGLEPDSGRLLYEVAEETLGDEHPLAVLSGPTFAIEMAKGLPTAISMSSTDQAFVEELSGLLHCDRSFRVYTNNDFIGVQLGGVVKNVIAIGAGMADGIGFGANARTALITRGLAELTRLGLKLGAKSETFTGMAGLGDLILTCTDNQSRNRRFGMALGQGKGVEEALKSIGQSVEGYRNTREVVALAARNEVEMPICEQIYAVLYEGKEPQQAAIDLLSRERKTE

SEQ ID NO: 29736 - protein, 204 aa, Viburnum lantanoides
YNKPVKGRKINWMKAGILESDRVFTVSPYYAEELVSGVDKGVELDNIIRKTGITGIVNGMDTQEWNPATDKYVGVKYDITTVMDAKPLLKEALQAEVGLPVDRNIPLIGFIGRLEEQKGSDILAAAIPKFIEQNVQLVVLGTGKKYMEKQLEQLEILYPDKARGVAKFNVALAHMIIAGADFMMIPSRFEPCGLIQLHAMRYGT

SEQ ID NO: 29737 - protein, 204 aa, Viburnum lobophyllum
YKHPVNGRKINWMKAGILESDRVFTVSPYYAEELVSGVDKGVELDNFIRKTGITGIVNGMDTQEWNPATDKYVGVKYDITTVMDAKPLLKEALQAEVGLPVDRNIPLIGFIGRLEEQKGSDILAAAIPKFIEQNVQIVVLGTGKKYMEKQLEQLEILYPDKARGVAKFNVDLAHMIIAGADFMMIPSRFEPCGLIQLHAMRYGT

SEQ ID NO: 29738 - protein, 194 aa, Corynebacterium glutamicum
MADHKDLNVPANPYGTDIESVLISEEKLKQRIAEMAKRVSEEFKDAEEDLILVCVLKGAFYFLADFSRMLDIPTQSEFMAVSSYGNSTSSSGVVRILKDLDKEIEGRDVLIVEDIIDSGLTLSWLMRNLKNRNPKSLNVITLLRKPERLTTNIDMFDIGFDIPNEFVVGYGLDFAERYRDLPYVGTLEPHVYSD

SEQ ID NO: 29739 - protein, 354 aa, Glomus mosseae
MAVANKSNTQTLAKYLSLDQGGKIQAEYIWIDGDGGLRGKTTTLDFKPTDVSELKEWNFDGSSTNQAPGDNSDILLRPCAIFKDPFRGGDNILVLAECYNNDGTPNRTNYRHSCTKLMSAHSEAKPWFGIEQEYTLFDMDGQVLGWPKGGFPGPQGPYYCSVGANVAFGRDVVEAHYRACLYSGVNISGVNGEVMPGQWEYQVGPCEGIDMGDHLWVSRYLLQRVAEDFGIVVSFHPKPIKGDWNGAGCHTNYSTEAMRIEGGIKAIHDAIDRMSKRHAEHIAVYGEDNDKRLTGRHETGHISEFSFGVANRGASIRIPRHVAAQGYGYFEDRRPASNIDPYRVTEVIVESTLG

SEQ ID NO: 29740 - protein, 1286 aa, Unknown
  Nostoc sp. PCC 7120
MGILKNKSRSFSMFNCTTSLTPSELKSAIIRDPLIIKPETTVMDAIAQMSGVRVMCDTAKLDEVHLEARSSCVLIVAAGRLLGIFTERDVVKLCSQRRCLENLAIREVMIHPVVTLRESEFTDLFFAVNLLQQYRIRHIPILDEQERVVGLLTNESLRHTSRSVDLLRLRLVSEVMTCEVICATPDSSMLAIAQQMTENRVSSVMIVQLGQFQDKPQEIPVGIVTERDIVQFQALGLNLETCQVQTVMSSPIFAVRPDDSLRFVQQIMEQRLIRRLAVTGDQGELLGIVTQSSLLQALNPLEVYKLAQMLEEKVVRLETEKVQLLENRTVELEQLVADRTASLKAKAGREQIVSDISRQIRSSLSLQTILDTTVEQVRQLLGCDRVNIWYFETEWESIVMAESTTSSTSLLGERIEELCFQQHSAEIYRQGRIRVVPDIYTIEMTDCHREFLIRLQTRAKILVPLLCGDELWGLLNVSESQHPREWQTEEVELLQGLSVHLAIAIHQATTHQKLQEQLIALQQRSDQLRGSEQRYITLSQNLEAKIEERTAELQAREAQLQKTSDRLSISLKSGAIGCWDWDIVENNIFWDERMYELYGVTKTSDSRLVYDTWANRLHPDDRANIEVLVQQAILGQAEYDTEFRVIHPDGSIHFIKAYGVVVRDAEGNPQKMIGVHFDISDRKKSEEIIRQQVEREKLLREITQRIRQSLDLQTIFDIACQEICQVIQADRVGIFKFYPESNFNDGEFVAESVVKEFPSVIAIRVHDHCFGENYSSLYALGRSYVVDDIYHSDMTTCHTDILAQFHVRANVIMPLLCGAELWGLLCIHQCATTRHWQQSEIDFTQQLATQLAIAIQQASLVEQLQQELAERHQAELKLTQSNQQLAISNQELARATRLKDEFLANMSHELRTPLNAILGMTEGLQEGVFGMINNKQFKALETIERSSSHLLDLINDILDVAKIEAGQIKLDCTTISVANLCESSLVFIKQQALQKRIQVEIKIPFNLPDLFVDERRIRQVLINLLNNAVKFTPEAGRISLEVTQLSPDISTVQNFLQIAVIDTGIGIMQENINKLFQPFIQIDSALNRQYEGTGLGLALVKKIVELHGGRVGLTSELGIGSCFTIELPCIPSTPASPDLIRDLLTTPTPELDSPTADEAVSLAPVILLAEDNKANIKTFSSYLSAKGYDILLATNGQQAIELATIHQPDLILMDIQMPGIDGLEAIRQIRLDPQLVNIPIVALTALAMTGDRDRCLQAGANDYLTKPVKLKQLATTIQQLLITTKK

SEQ ID NO: 29741 - protein, 585 aa, Oryza sativa
MTPFTRSGNPMNPLAPVLTIDGPSGAGKGTISRIIARRMGWHYLDSGALYRAVGVAASWADIDTSDASALVRCTFDTRVQFVEQGEAMRVMVNGTDATDELRLETTGALASAIAAIPEVRAALKERQRAFRELPGLVADGRDMGTVIFKDAPYKVFLTASAEERAERRHKQLKDKGVSVNFDDLLREIMARDARDAQRTVAPLKPADDAVLIDTTGIGIADVVARVMDLLPGTPPTHVSNRVNLMTESFAELFEASQANLAKLKPGAIVSGTVVEVRGDVVVINAGLKSEGIVPIEQFRNDAGEIDVAEGDIVKVALDSIENGFGETVLSREKAKRAMVWDELEEALEKNETITGRISGKVKGGFTVDIKDVRAFLPGSLVDVRPVRDPAYLEGKELEFKLIKLDRKRNNVVVSRRAVVESEHSEEREQLMDKLQEGAILKGVVKNLTDYGAFVDLGGIDGLLHITDMAWKRVRHPSEVVNVGDELDVRVLKFDRERNRVSLGLKQLGEDPWDNIGRRYPANSRVFGKVSNVTDYGAFVEIEPGVEGLVHVSEMDWTNKNVNPSKVVQVTLNISHDSHRGLPMCE

SEQ ID NO: 29742 - protein, 104 aa, Brassica napus
MSLSAIGFEGYEKRLELSFFEPSLFLDTHGKGLRALPKSQIDEILAPAECTIVSSLSNDELDSYVLSESSLFIFPYKIIIKTCGTTKLLLSIEPLLRLAGELSL

SEQ ID NO: 29743 - protein, 382 aa, Unknown
  Nostoc sp. PCC 7120
MNLPSILVIDDLPDNFDVIETLLSEQDYTLHYVASGQEAIASLNLFQPDLILLDVMMPGMDGIEVCQRIKAMPQWQPVPIIMVTALTAKEDLARCLQSGADDFISKPINALELRARLHSMLRIKQQYDKIQTLSNLQTSTIKVLESTLDELRGNLAATLPHELNTPLNGIVGSISILMANIENMDTAEIQELLGWVDLSARNLERLIKQLLTYLELELSTNQQQNIASESTHFSIAAIEAILQSHAPSVNRRDDLMFAIEEAEVSISARYLTIIIHELVDNALKFSRRGTTIKISSQIVAGMLNVYIHDFGRGMTAEQISKIGAFMQFERKTYEQQGIGMGLKLAKQTVESYGGLFSISSVYQQETTVHIALPIAYSRHSSW

SEQ ID NO: 29744 - protein, 737 aa, Clostridium cellulolyticum
MDKMKRVSIYALIVAIVITITQFNFQYKCSSATAAFNYGEALQKSVLFYEAQRSGSLSTSNIPTRLLWRGDAQLTDGQKEGLDLTGGWVDAGDNIKFGITCAYTTSLLAFGAIEYKDAYEKSGQMKWLQNQLKWINDYFIKCHPEPNVFWAQVGMTANDHNNWIPIEVTHLMNDRAAIKLDERHPGTEVAMGTAAAMAASSIVFRNTDPTYADKLLEHAKQLYEFGDKYRGVFSDVIGKVDPQGAAAYTSHSGYKDELVWGSIWLYKAMEAKSSGSGSDYLVKAKEYYNGIGKEANQQVHKYKWAHCWDDQSFGCYILMSQIDPENSLYREDAERWLNWWTVGGTENNADGTKISYTPGGHAKLDSWGSFRYVSTTALFAFVYSDKLNDTVKKARYHDFAVKQINYILGDNPRKSSYMVGFGQNYPQHPHHRTAHSSWGQQMDTPTEHRHILYGALVGSVDSTDGFNDSISDYVSNEVAIDYNAGLTGALARMYSEFGGTPIPDSSFPLPDKPYQPKNEWPVFAKTYYDGTSGTQFSLSVENRSAWPARSSNQLKIRYFFTLDAKDISDISIKAPAWVKVTGPTAWDKEKKVYYYTLDLSGKNIYPGYGWGTGGPELDFTISSASNTWDATSDWSYENWDATYVNGTRKYAPNIPMYEGDSFKKLAGNEPAGESEEPIILPGDINKDGNIDALDVALLKKYLLGNTLEYDISTADMNSDKNIDALDFALLKKALLSQ

SEQ ID NO: 29745 - protein, 743 aa, Aspergillus oryzae
MRPKPASSLQKTYDDCYLMCSTAVYFEGQNNEEEALKSWRSALETIYYHNAYRVPSKYTPKNETEKALQDSIRQLELQCRERVDLLEALRESRKDTSGKSPPFTTGYRGWIGEGTVPAVGYTDLSKPPTIPGRPPPPVTTASSESAGNETGSSVPMAGRPGLRKTQSSSAKTTSSRNSSPERRKAMPSTLRNADLKKPAKKKVSPRRKDLRPAAASQAAGLAWGSLYRTPSSEKTVSDAALASSRLTAANDPSFRKESIPPRSKSGDGVPPRKSVPPEDSGEERRSGRKLRVPGQTPRRSPAKSTPAPTSTPTSTPQAPAGIRQPSGNRTHSASVSTGSKDTVQPRASPKPSVKPKPVALRSSYQPPTPSGGSAGAATTSNNLQAGSASTPRRITPASTGEDALSDNIDRMSISRTSPERRATPRIRRAVTPPSSSDPESLGPKSTDADEDDVDVEDEDDAIMDILNKLPKGVDVATARQILNDIVVRGDEVHWDDIAGLDGAKKALKEAVVYPFLRPDLFSGLREPARGMLLFGPPGTGKTMLARAVATESKSTFFSVSASTLTSKWHGESEKLVRALFGLAKALAPSIIFVDEIDSLLSARSSGTENEASRRSKTEFLIQWSDLQRAAAGRESPRDKKAGGDPSRVLVLAATNMPWDIDEAARRRFVRRQYIPLPEHHVREKQLRTLLSHQVHDLTDQDIDALVQLTDDFEASLSSIRPSVSQEGLKEYEDWARQFGERGG

SEQ ID NO: 29746 - protein, 753 aa, Clostridium cellulolyticum
MNFKKYVRKTTAFATAMAVVSSVFLGSSVYAGSTTPPFNYAEAFQKSLYFYDAEKCGPGVTGGKLEWRGDCHVEDCELPLIPMKDYVGTNMSQAFIDKNKAFLDPDGNGSLDLHGGFHDAGDHVKFGLPQGYTISTLGWGFYEFKDSFTQINEEDHIRDILKWGNDYFLRSTFMDNKGEVVAFCFQVGDGTVDHAWWQPPELNKKSEVPRPAFFATSETPASDQCGEAAASLAINYLNFKDSDPAYAKKCLDTAKALYRFAVKNRGLGDSGGFYGSAYDEDELSWAAVWLNIATGEQSYINDITAISDGKYTGYMGKIIKSTQDNWQNIWVHSWDVVWGGVFAKLAPITNDPMHWYLFRWNLEYWSGIPHENPTDQTFMAATPGGFKVVNTWGSARYNAAAQLCAVVYTKYTDNMDVTEWAKSQMDYILGDNPMKRSYEVGFSEISAKHPHHRAAHGSKTLSMNDPLEHRHTLWGALVGGPDATDNHNDETTDFVSNEVAVDYNAGFVGALAGLYKYYGEGMKPLENFPPKEPAADDFYAESKLEQENTERTQVTVRIHNETSRPPEFVDELKARYFFDISEMLAAGQTIDDLTVAVMYDEGKASDGKETAINGPFAWDAEKGIYYVEMDWTGNAFYGDKEFHFGLVEGLDSNWKSHWDPTKTEQKSIEKIFYKSEISVRGDVKVYGNEPPKGSRNQTGRFKRGWKLDALDYAIMKKYILLPPGEVDLNTWDMNQDGEINALDLALLKKTLLG

SEQ ID NO: 29747 - protein, 639 aa, Thiobacillus denitrificans
MCGITGIFDTSGVNAISRDLLQRMNETQHHRGPDEGGLHLEPGLGLGHRRLSIIDLSSGQQPLANEDGSVVVVFNGEIYNFQELVPELEALGHVFRTHSDTEVIVHAWEAWGEACVARFRGMFAFVLWDRNQETLFVVRDRFGVKPLYYAFLDTGEFIFGSELKSLMVHPSLGREVDPLAVEDYFAYGYVPEPRTIFKRVHKLPPGFTLTLKRGAPRALPKQYWDMPFAPVAVKDEAGAMDELVERMKESIRLRMIADVPLGAFLSGGVDSSAVVAMMATQSSTPVNTCSIGFDDPAFNEIEYAQQVADRYHTRHHVETVAADDFSLVGKLAQVYDEPYADSSALPTYRVCELARKHVKVALSGDGGDEHFAGYRRYRWFRYEERMRSIIPLGLRRPLFGTLGLLYPKADWAPKMFRAKTTFEALARDTVEGYFHGVSLLSNAQRAQLFSPAFRRELQGYQAVDVLRRHAAVAPTDDPLSLVQYLDMKTYLVGDILTKVDRASMAHALEVREPLLDHELMGWVSGLPVDLKLRGSEGKYLLKKAMEPYLPHDVLYRKKMGFSVPLAAWFRGPLAATIRTVVLGERLAGTGMFNCEFLREVVEAHQSGRRDFSVILWTVLMFDAFLGQVLGLDDTAREAA

SEQ ID NO: 29748 - protein, 526 aa, Clostridium cellulolyticum
MKSKLIKLSAIIISGVMLTTSFVNTGTAFAAGTHDYSTALKDSIIFFDANKCGPQAGENNVFDWRGACHTTDGSDVGVDLTGGYHDAGDHVKFGLPQGYSAAILGWSLYEFKESFDATGNTTKMLQQLKYFTDYFLKSHPNSTTFYYQVGEGNADHTYWGAPEEQTGQRPSLYKADPSSPASDILSETSAALTLMYLNYKNIDSAYATKCLNAAKELYAMGKANQGVGNGQSFYQATSFGDDLAWAATWLYTATNDSTYITDAEQFITLGNTMNENKMQDKWTMCWDDMYVPAALRLAQITGKQIYKDAIEINFNYWKTQVTTTPGGLKWLSNWGVLRYAAAESMVMLVYCKQNPDQSLLDLAKKQVDYILGDNPANMSYIIGYGSNWCIHPHHRAANGYTYANGDNAKPAKHLLTGALVGGPDQNDKFLDDANQYQYTEVALDYNAGLVGVLAGAIKFFGGTIVNPPVKKGDLNNDTFIDAIDLALCKNYILTQNGNIDKNNADMNGDGSIDAIDFSLLKKAILG

SEQ ID NO: 29749 - protein, 82 aa, Arabidopsis thaliana
  misc_feature (70)..(70): Xaa can be any naturally occurring amino acid
KSSAAFPVTRKTNKDITSIASNGGRSSCMKVWPPIGKKKVETLSYLPDLSDVELLKKVTTFSANRWIPCXEIRVKARIVYRE

SEQ ID NO: 29750 - protein, 223 aa, Aspergillus oryzae
MSGLADPASRNTVVSGATDVPGRTRKLPLLSSSVPASGQPMGDPMEVTPPASAAATGAGPSAHNNSDNDRAGASTIATSNGSTEPAHVHNHVAPSQAIGAAAAAQQPKVVQTAFIHKLYNMLEDPSIQHLISWSQTNDSFVMSPTPEFSKVLAQYFKHTNISSFVRQLNMYGFHKGMSTRLVNEFRPLSVAHMERLSERCVPHWIARLGTLGVQAREWQFQTW

SEQ ID NO: 29751 - protein, 285 aa, Xylella fastidiosa
MTTKDTWFTEHFQATGSAIGFRVTGKLDEVQSPFQKIEIYNSTDWGKLMVIDGALMLTSRDNFIYHEMISHPALFTHTAPKCVVIIGGGDCGTLREVLKHPDIEQVTQCDIDEQVTRMAEKHFPELCTSNNDPRATLLFSDGVAYMADCPTNSVDVIIVDSTDPIGPAKGLFNRTFYESCFRALKNDGLLIQQSESPLALLELIKEMRHEMSKAGFKAFKTLPFPQPCYPTGWWSVTLSSKQPNANFAFRQTDAQTKPFDTLYYNAHLHHGVLAPPPFIAHALGE

SEQ ID NO: 29752 - protein, 242 aa, Prochlorococcus marinus
MFEFLKKLMTNNESVSAKETNFLHRILNTDIKQEPKSQEDEIIFGCGCFWGAEKCFWKLPGVITTSVGYAGGEKNNPTYYEVCSGITGHAEVVRVVWNVNEIDISDLLKMFWECHNPTQKNRQGNDMGTQYRSTIYYKNDINKDKIYSSKEAFQKELYKNNLGIIETEIKKIDTYYYAEEYHQQYLAVEGSRQYCSASPTKVKLGSFNNCNYKLPTKTWDNFNWDIDKCVLRSNNNPIDINN

SEQ ID NO: 29753 - protein, 831 aa, Vibrio vulnificus
MHFDSGLLALLFVIIALFIGALVRHLLKGSQVPYTVALLILGIAIGLAHRGNAFTDNYTLIGETLSLASEIDPHLFLFLFLPTLIFESAFAMEVHLFRRMFTQIVILAVPGLMLAIWLTAELVAWVLPEHWQWSWALCLMFGALISATDPVAVVALLKEVSSRKRLETLIEGESLLNDGTAIVFFSLFYGWVLMEFSNPGEAITAPPWQAVAQFFVVVFVGLAVGLILGGLCILWIDRVFNDPMIEISLTIAAAYSAFFISENFHVSGVVAVVTLAIMFASVGRTRISPEVAGFLHHFWEMMAHMANTLIFLLVGILVAIRVPLDDKEAWLALFVLYLGIMAIRACSITVFMPILKRIGIGITYEKAVVLCWGGLRGAVSLALAMTVASSDIIPKQIGDHVLFLCAGIVVLTILFNGSTMGHVLKWLNLSSLPPGKQATVDKAQHEVNRVLHDMLPTMMTSDFLKGADWETVKQGAKLQVLKECNSPTEITQDELHTAYLRRLLETERKHYWTQFSQGLIGKQATNKLVEAVEHALDGDPIIGPRNELFTTWRLPDWVEPLRQYNSWNKLLLKVYFRRLALGYDVARGFIQAQEALESHIDTLAPDAEIAVMVRQQVELNKRLTFERIESLRMSFPEIIQALQSQAATRLLLNRERAVINDQLKQAVLDKPEAQKLLNMVEERMAALQKESIFDKSQEQKLINDIPWARELKSKTREELTSWIEHTVYDAGQLICENQRPLNRIGIVSRGSITELYETRSDDNLEKVRTTIGPGETFALISLLTGKTNAQYVSDTPTDIMWLPVDKLKLLMNQDPNLTAVVCQLFKQLKSV

SEQ ID NO: 29754 - protein, 277 aa, Gibberella zeae
MDPQNSQAAQQSRQRPVYDPSQGGHYGASAQLASQGFAPSELYTGPWANAHQGLTGQYKDILTTYWQHTISHLENDTHDYKIHQLPLARIKKVMKADPEVKMISAEAPILFAKGCDIFITELTMRAWIHAEENKRRTLQRSDIASALAKSDMFDFLIDIVPREEASSHAKRATQTAAAQPLPAGQAQMPGQHPMAQAPNPGHPMGAEYMPSHGIAPEQDYRNPANMYPDQSVPNPQAAYGQAQQPNMNPYGAMGDMYPYPGMAPQQTTMSNEEFGEQ

SEQ ID NO: 29755 - protein, 313 aa, Unknown
  Candidatus Kuenenia stuttgartiensis
MEKLPLNWIDDYFSDYELHKLAFKNIVYEAESKHQKIIVVDTYSFGKCLILDNEFQSAESDEYVYHESLVQPSLIMHPEAQSVLIIGGGEGATLRETLRHKSVKKAVMVDINDEVISCAKKSLPSFHEGAFDDERTSLVIEDGRKYLENTDQQFDVIIIDVNDPVGGSPSAMLFTREFYQIAAGRLKKDGIVVVQSGAVSVTDNDLFSGIFHTLNDVFPHVFPYTTYIPSYACLWGFTIATHNLGDLDITGEEIDFRIGNRVNSALRYYDSITHHSLFNLPKYLREELKKSKHIIRDNAPLIKQYPGVSSEKI

SEQ ID NO: 29756 - protein, 566 aa, Clostridium perfringens
MSKKIVIVGGVAGGASTAARLRRLDENNQIIMFERGPHVSFSNCCLPYYLSGKVENHEDLVLMTPEKFYSQYRIDARVYTEVVSINRKAKEVTVRNVVSGQEYTESYDKLVLSPGAKAIVPPIKGIEDVNVFTVRNVVDIAKLDSFIKDNNSKNISVIGGGFIGVEVAENLHEAGYNVTLIEAMDQIMKPFDYDMVQVLHKEMYDKGVNLIVGDKVSSFESGKVVLESGKKINSDAVVMAIGVAPETDLAREAGLEIGQTGAIKVNQNYLTNDKDIYAVGDAVEVYNSLTNSISRLPLAGPAQKQARAVADHIHGRPSRNSGYIGSSCVQIFHYNGASTGLTEGQIKAMNLSLNYDVVRVIPQDKVGLMPGSEPLHFKLIFEVPTGRILGAQAIGKGNADKRVDIIATLIKMGGTVEDLKDLELCYAPPFGTAKDVVNHAALVASNLLEGTFKQVYVHEVRDLVESGACIIDVREVSEYEAGHIKGAKNLPLSEIRDRLDEIPTDRPVYLHCRSAQRSYNACLALQHLGFDNIYNVSGGFMGISFYEYYNDKVQDREPIVTEYNFN

SEQ ID NO: 29757 - protein, 351 aa, Bordetella bronchiseptica
MSQARPATLRVAVLGAGSWGTALAAAASRRHPTVLWARDGAQAQAMAARHENTRYLPGVALPPALQVSADLAQALAHLAHDPAHALIILGVPVAGMTPLCTELAARLPALGLQAVPLVWTCKGFEEQTARLPHETVQAALGAMPGLAAGVLSGPSFAREVAQGLPVALTVASESSAVRDAVTTALHGAAVRIYASTDVVGVEVGGALKNVIAVACGICDGLALGTNARAALITRGLAEMARFGAALGAQQETFAGLTGLGDLVLTATGELSRNRRVGLEIGAGRKLADILASGMTAEGVRCARAARDRARALNIELPITEAVCAVLFEGLSPMTAVSALLAREARPESPTP

SEQ ID NO: 29758 - protein, 304 aa, Anabaena sp.
MTQAKAKHADVPVNLYRPNAPFIGKVISNEPLVKEGGIGIVQHIKFDLTGGNLKYIEGQSIGIIPPGVDKNGKPEKLRLYSIASTRHGDDVDDKTISLCVRQLEYKHPESGETVYGVCSTYLTHIEPGSEVKITGPVGKEMLLPDDPEANVIMLATGTGIAPMRTYLWRMFKDAERAANPEYQFKGFSWLVFGVPTTPNILYKEELEEIQQKYPDNFRLTYAISREQKNPQGGRMYIQDRVAEHADQLWQLIKNQKTHTYICGLRGMEEGIDAALSAAAAKEGVTWSDYQKDLKKAGRWHVETS

SEQ ID NO: 29759 - protein, 981 aa, Aspergillus oryzae
MDKQQKLSARPSGIPRLASRLPLPTSTASKSIKPSPSREKLRTDTGVDTARLRRPSEEPLFKKPLPKYSVPKKTQNGLPQRRDVSQTRMSDGGKSETDSVLFRHGTDVSVDDADTRGRARPSLSERTIETLSQIPPSPSSSRHSSFFNGTSPMRSPSRPPSALSSCSRSPSRSSSSRQQIGGDFFRPSSAMRLPSRSRQSLYVGGTSAELNSVTSSDSASKLKLPTSRTSTFRDTKHTLSTLRGSSGTAVIQIPDTNITQEGLHVKKTRKTPTKTHQNSRAPTKMPKSPSTKATTLDLTLEQQSEMETRRTSRSSSALRESIAKAKAARKAAMQSVDNSQSSSLDELSVEDPFNQRPKDSNKGLLRKRLEAGRTSGHLNIAAMSLTALPEEVMTMYDFDPDSVTEWYESVDIVKFIAADNEFVELPDSAFPDTDPEDQDADERGNQFGGLEVLDLHGNLLRSLPIGFRRLQRLHTLNLSNNKLNLEDIQIIMEMESVKDLKLAKNHLQGSFPADIKNLSNLEVLDLHSNSLTELPNEVAYLTSLRVLNVGDNHLSTLPFEGLSKLSLKELSAPNNRLKDTLLPASVQALMTLQYLNVTGNSLTKLSNHDTLELPNLHTLAISMNRIQCLPDVSSWQALLSLSAENNSIADLPRGFTDLKAVRNVDLTGNNISKLDERIGLMESLVIFRIANNPLRERKYLNMSPEDLKRELRNRCEPEPQDTDDEEGSVATQFTLAPEAPAQSGVWQVKPGGVLDRSYADLQDLDMDHLERINPHEVRCLYLQHNELRCIPAPTLSMLALNLTDLDLSHNPLDSTSLSPTSLDLPSLQILNLSATGLTSLEPLLASLQAPSLTFLDVSNNRICGSLPPVRQTYPSLMTFLAADNQFDSLEFDAIQGLQVLDIGNNNISFLPPKLGLLRAEGCSKNWGNGSALKRFEVAGNSFRVPRWQIVAKGTDAILEWLKDRIPAEDLCQWEPDDESSI

SEQ ID NO: 29760 - protein, 903 aa, Gibberella zeae
MKGGEYRRRLKWGRGNHLVPIYYTKMFDVVHFSDRSPYVVKRVRIQLSYLEFNRFSFCAFLSHCVIAVAAYRSYMYRTNQHLTVQPPTSVSSCDARTINYITHTLPQSCLTISWTSSTTTSTPSLSNSTSDTSSDPAQSNAPSSSVLSDSQSQPQPSSTATPPKDESQDAAGDGAEKPFMSFEDWKELMLRKTGQDPQDLHARNTKPRDRTPPDMGHAGLGEEDEISLNFDSYLDNAGKQNEPPSDVDQAKGDGSAKAISIHRSKDAGKTCKERFSYSSFDAGATILKTSPGAKNAKAILVENKDSYMLLECSAKSKFVIVELSDDVLIDTVVLANFEFFSSMFRHFTVSVSDRYPVKMDKWKEIGLFEARNSRDIQPFLVPNPQIFSKYVRIEFLTHWGKEFYCPVSLLRIHGSRMLDSWKEADQARDDDSNPEEEAEETQQSLPSGEEAPKIQGAEKNPEPVKTTAMEKMPYCELNATSHVFMVPLFCPVSLNPTTSTTSNQNSSVEVTSAAPTPNSSEDREQKGHSTQHNPRAERPASDEPTSSAFSKTASPSATPAISPTSPSSVSSSNVESVSNFTSQTQSSRTTSTPSSSTNPSIAKPSPANTVNAKKGTTGTASGSPASPTVQEGFFKAISKRLIAVETNLTLSLKYVEDQARHMSETLQRTEQKQISKANLFFEELNRTVVAELRSAREQYDQIWQSTVIALESQREQSNREIVALSSRLNLLADEVVFQKRMAIVQAVLLLSCLLLVIFSRGGSLPYLAPLVDQANLAQYDTGSPAARLRALYGDVYGADGQSAALLAARQRVFVPMTEAADHSDSTELRQRSSLVDEMRNEQAEREQLSPPQTPRSADSFLSSSGRLPSPRETQPSLLRHAPAIHSGNSRKPLPALPENPASP

SEQ ID NO: 29761 - protein, 540 aa, Unknown
  Rhodococcus sp. TK6
MTAQTIHTVDAVVIGAGFGGIYAVHKLHHELGLTTVGFDKADGPGGTWYWNRYPGALSDTESHLYRFSFDRDLLQESTWKSTYITQPEILEYLEDVVDRFDLRRHFKFGTEVTSALYLDDENLWEVTTDHGEVYRAKYVVNAVGLLSAINFPNLPGLDTFEGETIHTAAWPEGKSLAGRRVGVIGTGSTGQQVITSLAPEVEHLTVFVRTPQYSVPVGNRPVTPEQIAEIKADYDRIWERAKNSAVAFGFEESTLPAMSVSEEERNRIFQEAWDHGGGFRFMFGTFGDIATDEAANEAAASFIRAKVAEIIEDPETARKLMPTGLFAKRPLCDSGYYEVYNRPNVEAVAIKENPIREVTAKGVVTEDGVLHELDVLVFATGFDAVDGNYRRIEIRGRDGLHINDHWDGQPTSYLGVSTANFPNWFMVLGPNGPFTNLPPSIETQVEWISDTIGYAERNGVRAIEPTPEAEAEWTETCTEIANATLFTKGDSWIFGANIPGKKPSVLFYLGGLRNYRAVMAEVAADGYRGFEVKSAEMVTV

SEQ ID NO: 29762 - protein, 431 aa, Thermococcus kodakarensis
MIDKVYCADVTPEMEGKKVKLAGWVYRKREVGKKVFIVLRDSSGIVQVVFSKDLNEEAYREAKKVGIESSVIIEGTVKADPRAPTGAEVQGEKLQIIQNVDFFPITKDASDEFLLDVRHLHLRSPKVAAIMKVKGTLMQAAREWLLQDGWYEVFPPILVTGAVEGGATLFKLKYFDRYAYLSQSAQLYLEAAIFGLEKVWSLTPSFRAEKSRTRRHLTEFWHLELEAAWMDLWDIMKVEEELVSYMVQRTLELRKKEIELYRKDDIKTLKNAVPPFPRISYDEAIDILQSKGVNIEWGEDMGADEERVLTEEFESPFFVYGYPKHIKAFYMKEDPEDPRKVLAADMLAPEGYGEIIGGSQREDDYDKLVQRILEEGMKPEDYEWYLDLRKYGSVPHSGFGLGLERLVAWVLKLDHVRWATLFPRTPSRLYP

SEQ ID NO: 29763 - protein, 261 aa, Triticum aestivum
VRLTVIEFETKLLEIEDTSQEAVCWIRRLPPRLWATAYFEGIRYGHLTANIMESMNSWILDASVLPLNQMMEVLRRQLMTWFNERREASMQWATILVPTAERRVQEAIERARGFQVARANEAEFEVISPHEGTNVVDIRNRCCLCRGWQLYGAPCSHGVAALLSCRQNVHRYTESCFTVATYRKTYSQTIHPIPDKTLWNEGQPAEDRLEVIINPPKSLRPPGRPRKTRVRAEDLGRVKRVVHCSRCNQTGHFRTTCAAPI

SEQ ID NO: 29764 - protein, 276 aa, Bacillus licheniformis
MSGLWYTEKQTKNFGITMKINRTLHTEQTDFQKLEMAETEEFGNMLFLDGMVMTSEKDEFVYHEMVAHVPLFTHPNPEHVLVVGGGDGGVIREILKHPSVKKATLVDIDGKVIEYSKKFLPSIAGKLDDPRVEVKVDDGFMHIAQSENEYDVIMVDSTEPVGPAVNLFTKGFYAGIAKALKEDGIFVAQTDNPWFTPELITNVQRDVKEIFPITKLYLANIPTYPSGLWTFTIGSKKYDPLEVEDSRFFDIETKYYTKEIHKAAFVLPKFVSDLIK

SEQ ID NO: 29765 - protein, 463 aa, Oryza sativa
MPASTAASAAKSPRLRLHHLLLSILSALPTCPLDHSTPTSAASAAAATASHHHVVTTLPGYDGELPFRLETGYVAVDEEEHGAELFYYFVESESGDPRRDPLLLWLTGGARCSVLSGVFFEVGPVRLALEHHRPYDAGELPRLRYHPHGWTKAASVLFVDSPVGAGWSFSRHPDGYLVGDVSASLQLKHFLAKWISDHPEYLANPFYIGGDSYAGKIVPFLAQKISEDIEAGVRPIVDLKGYLVGNPVTGESIDFDSRVPYAHGVGIISDQLYETIMEHCQGEDYSNPKNAICRQALDRFNELLGESSGGHILYNYCIYDSDIDGSIQEKPKIPPFPPRECIGSVDEWLRCHNGDLPYSMDIKSNIKFHHNVTTKGYRALVYSGDHDAMIPFLGTQAWVRSLNFSVVDDWRAWHVDGQSAGFTITYMNNMTFATVKGGSHTVPEFEPERSLAMFKRWISNEPL

SEQ ID NO: 29766 - protein, 112 aa, Xanthomonas campestris
MKMIMAIVKPFKLDDVREALAGCGVAGITVTEVKGFGRQKGHTELYRGAEYVVDFLPKVKIEVAVTDDQAERVVEAIVAAAGTGKIGDGKVFVYDLGTVVRIRTGELDSDAL

SEQ ID NO: 29767 - protein, 729 aa, Unknown
  Bradyrhizobium sp. BTAi1
MLRVLSKSMPLFGRLDRAVDALVRLIGHFGSAVIGLSAIALVWVGIVYTITEERARTEQSALKNGANLARAFEEQIIRSIRAADQTLLYVRDSYAKDPQNFDMSLWARNSQFLSDFSFQVVVIGKDGIMLSSNIDPKMRGLDLHDREHFRVHADGTADFLFISKPIFGRVSNKWSIQLTRRIILQDGSFGGVVVVSLDPEYLSSFYNSVDIGKNGNVTLVGTDGIVRARASAGPSAVGSSLAGSPIMANIEQKTSGSYITKSQIDGISRIYSFRRVKDQPLVVVVGQATDEVFSAIRVDRGLMVGTLLTVIIGIITILIARYQAGLAASRDAAEAGTRARSEFLAMMSHEIRTPMNGVIGLADLLLSADLAPEQRKIATTLRESADYLLQLLNDVLDFSKLDADRLEIEHIEFDLHRSVTATAELLVSRAKEKGLQLTTSIAPDVPNYVVGDPARLRQVLFNLVGNALKFTEAGSVNIDVRAENLAGPNLTLVFSVADTGVGIPAEAVGRLFRQFSQVDNSISRRFGGTGLGLAICKRLVTCMGGDIKVQSKIGEGSTFTFSIEVQPQPQPDVEQLSVPEAPIVPVGESVSEERPANFEPLKVLVAEDNLTNQFVIKKLLDKLGHGYDIVDNGTQAIAAVQKHAYDLVLMDMMMPEMDGLTATRMIRSLPPPARDIYIIALTANATSQDHLACTDAGMNDFVTKPVTRDRLNAALLRATAAKHKERLVA

SEQ ID NO: 29768 - protein, 560 aa, Oryza sativa
MASHIILPKEEEAALGVAVEEDHDSPAAPGYQHQQGPPVAKALPFSATCVRISRDSYPNLRALRNASAMSLPDDDAAYAKLEEGDYGYLLDDVPHFTDYLSDLPTFPNPLQDHPAYSTVKQYFVNADDTVPEKVVVQKDSPRGVHFRRAGPRQRVYFESEDVKACIVTCGGLCPGLNTVIRELVCGLSHMYNVNDIFGIQNGYKGFYSSNYLPMTPKSVNDIHKRGGTVLGTSRGGHDTKKIVDNIQDRGINQVYIIGGDGTQKGAYEIYKEIRRRGLKVAVAGVPKTIDNDIAVIDKSFGFDSAVEEAQRAIDAAHVEASSAENGIGLVKLMGRYSGFIAMYATLASRDVDCCLIPESPFYLEGEGGLFEYIEKRLKENNHMVIVVAEGAGQDLIAKSIAAADQIDASGNKLLLDVGLWLTHKIKDYCKNKKMEMTIKYIDPTYMIRAIPSNASDNVYCTLLAHSAIHGAMAGYSFTVGMVNGRHAYIPFHRVTSTRNKVKITDRMWARLLSSTNQPSFLSQKDIDAAREADKLASKSPVPVNTKEHGENVKKPANGEK

SEQ ID NO: 29769 - protein, 551 aa, Actinobacillus pleuropneumoniae
MYCVQCEQTMVTPMGNGCSFGQGMCGKTAETSDLQDLLIACLHSLSAWALKAREHGIINHDADNFAPRAFFATLTNVNFDSNRIVGYAQQAIIYRNELIKAISEVEPNPELNHPLAHIELKGISIDQLAEQAKEFALDTDRAEIGEEVHGVRLLALYGLKGAAAYLEHAYVLGKFDNDLYVEYHGFMAWLGTKPSDLNELLEKSLAIGSMNFKVMAMLDAGETETFGNPVPATVNIRPVKGKCILISGHDLKDLKELLEQTEGKGINVYTHGEMLPAHGYPELKKYKHLVGNYGSGWQNQQKEFARFPGAIVMTSNCLIDPNVGDYADRIFTCNIVGWPGVVHLEKHNFAPVIEKALECDGFPYTELEHYITVGFGRKTLIDASDAVIDLVKAGKLSHVFVIGGCDGDKEERHYYTDLAYALPKDTAVLTLGCGKYRFNKLDFGTIDGGLPRLLDAGQCNDTYSAIMLAVTLSQKLGIGLNELPLSIVLSWFEQKAIIVLLTLLALGVKNVYSGPSKPAFLNDNVMNLLHEKFGLSGLTTPEQDFGHIINK

SEQ ID NO: 29770 - protein, 213 aa, Thermus thermophilus
MSAAQPNPVYRASWRLARFLLRLLFHYRVEGAEKVPAEGPVILAANHLSILDPIVVGAGIRRPVSFMARADVFRLPFLSWLLPRLYAIPVERGSGDLSAVKGAIRALERGMAFGIFPEGTRSRTGKLQPFKTGVAAIALRTGSPVVPVAVVGTEEAWPVGKKLFRPCRPVRVIYGDPIPVPRKSKVSHRELEALTREIEARVRDLLPPRYWGS

SEQ ID NO: 29771 - protein, 520 aa, Unknown
  Bacillus sp. WCS10
MKGKKWTALALTLPLAASLSTGVHAETVHKGKSPAADKNGVFYEVYVNSFYDANKDGHGDLKGLTQKLDYLNDGNSHTKNDLQVNGIWMMPVNPSPSYHKYDVTDYYNIDPQYGNLQDFRKLMKEADKRDVKVIMDLVVNHTSSEHPWFQAALKDKNSKYRDYYIWADKDTDLNEKGSWGQQVWHKAPNGEYFYGTFWEGMPDLNYDNPEVRKEMINVGKFWLKQGVDGFRLDAALHIFKGQTPEGAKKNLLWWNEFRDAMKKENPNVYLTGEVWDQPEVVAPYYQSLDSLFNFDLAGKIVSSVKAGNDQGIATAAAATDELFKSYNPNKIDGIFLTNHDQNRVMSELSGDVNKAKSAASILLTLPGNPYIYYGEEIGMTGEKPDELIREPFRWYEGNGLGQTSWETPVYNKGGNGVSVEAQTKQKDSLLNHYREMIRVRQQHEELVKGTLQSISVDSKEVVAYSRTYKGNSISVYHNISNQPVKVSVAAKGKLIFASEKGAKKVKNQLVIPANTSVLIK

SEQ ID NO: 29772 - protein, 728 aa, Oryza sativa
MDASAGSSAPHSHGNPGKQGGGGGGGGGRGKAPAAEIRGEAARDDVFFADDTFPLLPDFPCLSSPSSSTFSSSSSSNSSSAFTTAAGGGCGGEPSEPASAADGFGELADIDQLLDLASLSVPWEAEQPLFPDDVGMMIEDAMSGQPHQADDCTGDGDTKAVMEAAGGGDDAGDACMEGSDAPDDLPAFFMEWLTSNREYISADDLRSIRLRRSTIEAAAARLGGGRQGTMQLLKLILTWVQNHHLQKKRPRTAIDDGAASSDPQLPSPGANPGYEFPSGGQEMGSAAATSWMPYQAFTPPAAYGGDAMYPGAAGPFPFQQSCSKSSVVVSSQPFSPPTAAAAGDMHASGGGNMAWPQQFAPFPVSSTSSYTMPSVVPPPFTAGFPGQYSGGHAMCSPRLAGVEPSSTKEARKKRMARQRRLSCLQQQRSQQLNLSQIHISGHPQEPSPRAAHSAPVTPSSAGCRSWGIWPPAAQIIQNPLSNKPNPPPATSKQPKPSPEKPKPKPQAAATAGAESLQRSTASEKRQAKTDKNLRFLLQKVLKQSDVGSLGRIVLPKKEAEVHLPELKTRDGVSIPMEDIGTSQVWNMRYRFWPNNKSRMYLLENTGDFVRSNELQEGDFIVIYSDIKSGKYLIRGVKVRRAAQEQGNSSGAVGKHKHGSPEKPGVSSNTKAAGAEDGTGGDDSAEAAAAAAAGKADGGGCKGKSPHGVRRSRQEAAAAASMSQMAVSI

SEQ ID NO: 29773 - protein, 463 aa, Bacillus cereus
MENTLVKSLYRDTDKYAGQTVQVSGWIRNLRDSKAFGFIELNDGSFFKSVQIVFDTELDNFKEIAKLPLSSSVKVEGKVIVTPGAKQPFEIKAEKIDIEGLSDSDYPLQKKRHTFEYLRTIAHLRPRTNAFSATFRVRSIAAFAIHQFFQERGFVHVHTPIITGSDTEGAGEMFRVTTQDLNNVPKGEDGQVDESKDFFGKETNLTVSGQLNAEAYALAFRDVYTFGPTFRAENSNTTRHAAEFWMVEPEIAFAELGDVMNLTEDMLKYAMKYVLEHAPEEMEFFNSFVDKTVLERMNNVINSDFGRITYTEAIKVLQESGADFKYPVEWGIDLQTEHERYLSEEIFKRPVFVTDYPKDIKAFYMRLNDDGKTVAATDLLVPGIGELIGGSQREERMDVLVDRIKELGMNEEDYWWYLELRKYGGTKHAGFGLGFERFLMYITGMANIRDVIPFPRTPGSSEF

SEQ ID NO: 29774 - protein, 122 aa, Glycine max
MARRPARCYRYCKNKPYPKSRFNRGVPDAKIRIFDLGRKRANVDDFPLCIHLVSNEYEQLSSEALEAARICANKYLVKVAGKEGFHLRVRVHPYHVVRINKMLSCAGTDKLQTGMRGAFGKP

SEQ ID NO: 29775 - protein, 251 aa, Streptomyces coelicolor
MISSFDLTGRTAVVTGGGRGLGLGISRALLNAGADVVVLSRSALDDRLRRTAADLGRSVSHVGVDLRDREGVAAAGAEVLAGHQVDILVNNAGAQIRHPAEDFPLDAWDAVLDVNLRSVVQLCQIFGRPMIQRGEGKIINLASLLSFQGGFTVAAYAASKGAVAQLTKALCNEWAGRGVNVNAIAPGYMATEMNTALLEDPVRLEQLSVRIPAGRWGGPDDVGDVAVFLASRAAAYVHGQVLAVDGGWLAR

SEQ ID NO: 29776 - protein, 319 aa, Picrophilus torridus
MMNFNIRGNERNYETDYDVIIIGAGAAGYSAAIYAKRSGLNVAILEREAVGGGNTAVSPLVENYLGFKAIEGADLAREFEKHAREYAKIITEIEARSIEKTSDGFKIKTNREDFTSRYIIITTGTTHRKIGVPGENEYYGKGVSYCSTCDGYLFKDKRVAVIGGGNSGAISAIYLNGIASDTRIISHSDRYKCEDAYVETIKEKNIPFILNAETTEIIGDGKKVTGLKYTDKKTGKETEIEVDGIFVYVGIVPQTEFLKGSGVKMDDRGFIIVDDKMRTSVPGIYAAGDVVKGSEEQIATAVGDGCRAAITMYTDNMHK

SEQ ID NO: 29777 - protein, 995 aa, Streptomyces coelicolor
MLPIIGALRPWADPTMTSLLRLPMRARPAAEGDRRLSLDGTWSFRLFPSPDQVPADAVRGERAPGQWQSVDVPGSWPVQVADDIPHYTNIQMPFAEPPPRLPSRNPTGVYRTGFDVPSHWEGQRLLLHVGGADSVHAVYLNGVFVGYGTDARLGSEYDVTEAARVGRNQLAVVVVRYSAHSFLEDQDGWWLAGLHRGVRVEARPPVGLVDLDARADLDPRSGEGSLDVRATVDFGESTAAEGYRVRVSLSGRDGAGVAGPQDAPVPHAVNNTYEFSGHIARLHRDGLRILPWSAETPTLYEVAAELIDPAGDVVDATRVRVGFRRVEIDGPDFLVNGRRVWIFGVNRHDHHPDTGAAVTAEDMRADLAAMRRMNINAIRTSHYPNDPAFYDLCDELGFYVVDEANIESHAFNWYLCGDPRYRATWLERGARMVARDRNHPCVVQWSLGNESGYGVNHDALAGWIRRADRSRPLHYEDAIRNSGWTDGGRHATDVVCPMYPGIEEIRAYGEQVAAGAADRPLIMCEYSHAMGNSNGSLADYWDVITSTPGLQGGFIWEWKDHGLRQRLPDGTTRLAYGGQFGDAPHDANFVADGLVSADVEPHPGTAEVAWVYRPVTTEYVDGGLYVTNRRRFAGTGDLAAGWELLLDGAPSASGTLDVPDIAPGGSVAVPLPADAARAGAAQALLTITWRTRTESWFAPAGHPVAWDQLALRDGRTAPGPPVNGAVAVPGETADDPVPNVWRAATDNDGLKLMEHIVRVREMGSRTLIRWRDAGLDTRPAHEIVDHTVSVSRSESGADYRHRFEVPDEAADLPRVGVLFRVDPRFDRFVWFGRGPHENYPDRNRSAMLGRWSSHVEPSPYLVPQEFGLRTGTLWLELIDDDRGDRLRLTSLGGDFCWSATRYAPQALFAAGNASDLREDGRLVVCLDAAHRGVGTGACGPDVLPEYRIGPGRYELAYRMELVPAVQGVAGAPPHPQDSSRAASGGGSQCKDRHVG

SEQ ID NO: 29778 - protein, 1418 aa, Burkholderia mallei
MTSASVKTVCPYCGVGCGMVLHVEDGEVVKVSGDAEHPTNLGRLCTKGSSAHVALRNAGRLERAFVRDARELDPAPVPIADAIAETARRLRATLDAHGPDALAFYVSGQMSLEAQYLVNKLAKGYVRTPHIESNSRLCMASAGSGYKLSLGADGPPGSYQDFERADLFFVIGSNMADCHPILFLRMMERVKAGAKLVVVDPRRTATAQKADLFLKIRPGTDLALLNGLLHLLHANGRTDADFIAAHTEGWDAMPGFLADYTPQRVAALTGLAEADIRLAAQWIGDAREWTSCWTMGLNQSTHGTWNTNAICNLHLATGKICRPGSGPFSLTGQPNAMGGREMGYMGPGLPGQRSALDGDDRRFVEEIWGLPAGTIRPDAGGGTVDLFARMAAGDVKACWIICTNPVATVANRKNVITGLQAADVVIVQDAFLDTETNRYADILLPGALWAEAEGVMINSERNLTLMRQALEPPGDAWPDWRIVAAVARGMGYGDAFDYGSAAEVFDEIRRFANPNTGYDLRGASHAALRATPLQWPCPPEDGRDRHPIRYLNDGASRPRVTLPDGRVPPLAFPTPSGKARFFARSHVAPAEMPTPEFPIVLNTGRLQHQWHTMTKTGKVAMLNKLDARPFVEIHPDDAAALSIAANDAVEIRSARGRAVLPAVVTDRVQPGACFAPMHWNDVYGDDLCVNAVTNDAVDPVSLQPELKFCAVALARVDAPDSADAGAHAGAHAAPLHETGSREAQAQAGPRAHEAACADAAPEEHDMSDIDTFAALLGVPAATSAPQLTDAQRVYVAGFVSGLRSAEGRRAGGVPMLPASAPFDAKARLWLDGLLAGLFSRAPLGATARVDARAAAAAAVPAPSGAADAVSAPSGVRIVRTRPKVVLLWASQTGNVESLTERYATQLMDSGFEIRVACMSDYPAASLAKAQYALLMTSTFGDGDAPDNGQAFWTALAAAGAPRADGLRYAVLAFGDRNYDPFCGHGRRLDARLAELGATRLVERVDCDAEFQPAADAWLERAIARIKEEDAALHAVPADGMIPSGAIPTKTRPAASRLVANLRLNEPGAAKDTRCVSLSTDGAAIEYETGDALGVWPTNCPELVDELLALTRLKPDAPVTVAGMGELRLADALAKHLDITRPHPDALAFVASRSRAGDALARLLGDDRKTDLKHWLWGQQLADVLHEFPLELSAAELVGMLKRLQPRLYSIASSPSAHRGEIHLTVSAVRYGNGRRQRKGVASTFLADRAADAPVPVFVQKSAHFRPPASGDAPIVMVGPGTGIAPFRGFLHERRARGAKGRNWLFFGEQHADTDFYYRDELAQMRADGFLTRLDVAFSRDQTEKVYVQDRMLEQGAALWAWLEEGAHFYVCGDASRMAKDVDAALKTIVARHGGMTDEQAADYVARLTKDKRYARDVY

SEQ ID NO: 29779 - protein, 1040 aa, Candida albicans
MSYNNRSGGGASGGYSRRGYHGSHRGGYRTGRSKYPEDRYLVGGMLSLNKGSHYESSDNRYIPNEIGSKSPENRSHRSSTKDGRTPSGLSTPLSSSDKVSTPISIESINGSDRNTGVNNKDSEFPKLSHHSDFTSTIPFSRSINPQKNFMVINDSHTPKTDKGIQSKKIRYNGEGVNHVSDPRIAQSNSNLQKPTKKTKKTPYKQLPQPKFVYNSDSLGPAPMSTIIIWDLPISTSEPFLRNFVSRYGNPLEEMTFITDPTTAVPLGIVTFKFQGNPQKASELAKNFIKTVRQDELKIDGATLKIALNDNENQLLNRKLESAKKKMLQQRLQREQEEEKRRQKLVEEQKKQELLKKKEKEHQESVKKEKSVEHESTIVSTRDKNLVYKPNSTVLSMRHNHKIISSVILPKDLEKYIKSRPYILIRDKYVPTKKISSHDIKRALKKYDWTRVLSDKSGFFIVFNSLNECERCFLNEDNKKFFEYKLVMEMAIPEGFTNNIRENESKSTNDVLDEATNILIKEFQTFLAKDIRERIIAPNILDLLAHDKYPELVEELKSREQAAKPKVLVTNNQLKENALSILEKQRQLFQQRLPSFRMSHDRTQQHKPKRRNSIIPMQHALNFDDDEDSESHSQSESEDEDEDETTASRPLTPVVSTMKRERSSTITSIEDDIELEEREIKKQKVKVPAIEAEIAPESSPEEGEEEEKEEVEIKQEAEEVDIKFQPTEESPRTVYPEIPFSGDFDLNALQHTIKDSEDLLLAQEVLSETTPSGLSNIEYWSWKSKNRKDVQEISQEEEYIEELPESLQSTTGSFKSEGVRKIPEIEKIGYLPHRKRTNKPIKTIQYEDEDEEKPNENTNAVQSSRVNRANNRRFAADITAQIGSESDVLSLNALTKRKKPVTFARSAIHNWGLYAMEPIAAKEMIIEYVGERIRQQVAEHREKSYLKTGIGSSYLFRIDDNTVIDATKKGGIARFINHCCSPSCTAKIIKVEGKKRIVIYALRDIEANEELTYDYKFERETNDEERIRCLCGAPGCKGYLN

SEQ ID NO: 29780 - protein, 461 aa, Desulfitobacterium hafniense
MKKKWLGLGLGILIMVIAYFLPETAGLTQAGKMAIAILLTGIVLWVTEVMPLAITALLLMVCLPYFDILNWSTTWSKFISSVIFFVIATFAITVALIKTSLATRIAGVLVRWSKGDPKGLVLGFMVGSALLSSVCNNVPTCSLFMSLALSILITDNAIPGKSNLGKCLMIGIPFGTMIGGAMTPAGTSINIMAIGLLEEATGMTISFLDWMLMGIPFAVIMVPISWLSLVMIFKPEAISQKSEDTINNMVISAGRLTSQEKKIITIIGVMLVAWIASTWVPWLDATGIAVMGLIAFFFPGIEVLTWDEFVKGVSWEVILMIGGVQAVAAGIMATGAANWLVDGIMAGAANWSTPMLAGAAASVMTILHAICPVGPAICGMATVPISGLALLAGASPAVLTMIVALGAAITFILPLDCVPLITYSKGYYKMGDMVKAGIVPTIAMILVCAFVLPVLGPLIGI

SEQ ID NO: 29781 - protein, 703 aa, Clostridium acetobutylicum
MLHFLETDIAGRKLKVECGKTGMLSNCAMFISYGDTVVMVNVNASEKPREGIDFFPLSIEYEERQYSVGKIPGGFVKREGRPSEKSILHARAIDRPLRPLFPKGYRNDVQVVCTVMSVEQDNLPEILAMNGASMALCLSDIPFTTPVATVSVGCIDGKFVLNPTLEEREKSSLDLTVCATNERVMMLEAGADEIPEDLMIAAIDFGFNACQDIVAFQEKAMKEFGKEKVTPELYHPKEEIEKDVTEFAFESIKEIMYITDRDERNLRLREIKEKISNEFAEKYPDDGADIDEVVYTLQKKVVRNMLLKEHRRPDGRRFDEIRPISCDVDLLPRTHGSGLFTRGLTQVMTVTTLGPIGDAQVIDGLGVEESKRYMHHYNFPPYSTGEVKPLRGPNRREIGHGALAEKALVPLIPSEEEFPYTIRLVSEVLSSNGSTSQASVCGSTLALMDAGVPIKRPAAGIAMGLITSEDLSKEAVITDIQGLEDFFGDMDFKVAGTEKGITAIQVDTKIHGLSKYCIKTAINDARKARLFILEKMVACINEPRKELSTYAPRAYTINIDTDKIRTLIGTGGKTINKIIEETGVKIDIREDGTVFVLSSDADSANRALKMIDDLTKDVKVGEVYLGKVTKITNFGAFVEVLPGKEGLVHISKLDINKVNKVEDVVSVGDEILVKVTDIDNQGRVNLSRKDVLKQQESNNSKEK

SEQ ID NO: 29782 - protein, 112 aa, Unknown
  Acinetobacter sp. ADP1
MKLVTAIVKPFKLDDVREALSEIGVQGITVTEVKGFGRQKGHTELYRGAEYVVDFLPKVKIEIAISDEMVDAVIESITRVASTGKIGDGKIFVTNLEQVIRIRTGETGADAV

SEQ ID NO: 29783 - protein, 851 aa, Burkholderia mallei
MKIVVIGHGMVGHKLLECIAAGAPGALAAPRVAVVCEEPRPAYDRVHLSEFFAGKSADDLSLVEPGFFERHPNFRLLLNTKAVAIDRAARTVALSTGETLAYDKLVLATGSTPFVPNVPGRERAGCFVYRTIEDLEAMRACGARANSGVVVGGGLLGLECAKALRDMGLAAHVVEFAPRLMAVQVDEGGGRMLREKIEALGVQVHTGKNTLEIVDGETGAHRMAFADGTHLDADMIVFSVGIRPRDEIARACGLEIGPRGGVAIDERCRTSDEDIYAIGECAAWNGQTFGLVAPGYDMARVVARQLAGGEGAFAGADLSTKLKLMGVDVASIGDAHGRTPGSRAYQFADERRGVYKKLVVSECGKALLGAVMVGDAADYGTLLQMMLNRIELPRSPEFLILPQADGAAKPALGVDALPDAAQICSCNNVTKAQLREAVAGGATSLGALKGCTGAGTSCGGCVPLVTQVLKAEMKKQGLAVNNHLCEHFPYSRQELYHMVRVERFKTFGALLKKHGRGLGCDVCKPAVAGILASCWNEFVLKKEHAALQDSNDYYLANIQRDGTYSVVPRMPGGEVTPEGLIAVGEVARKYGLYTKITGGQRVDLFGARVEQLPLIWEELIAAGFESGHAYGKSVRTVKSCVGSTWCRYGVGDSVGLAIELENRYKGLRAPHKLKFGVSGCTRECAEAQGKDIGVIATEKGWNLYVCGNGGMKPRHAELLAADLDRATLVRYVDRFLMFYIRTADRLQRTSVWRDNLEGGLDYLIDVVVHDKLGLAAELEAEMQHVVDTYECEWKRAVTDPATRRRFRHFINSDAPDSTIAFVEARGQIRPVTPDERDAEGQADRQPETETA

SEQ ID NO: 29784 - protein, 201 aa, Aspergillus oryzae
MAIKTEESRTFNLTASRSTRSHSSFKPTTTLFALLERFPEERQELATMLIPKDDRKKIHEYLFREGVLVAKKDFESKHADIDTKNLYVIKALQSLNSRGYVKTQFSWQYYYYTLTPEGLDYLREWLHLPAEVVPATHIKQQRSHAPPRGMMGGEERERRGPRPTREGGYRRRDQEKEGGAPGEFAPNFRGGFGRGRGAPSS

SEQ ID NO: 29785 - protein, 225 aa, Oryza sativa
MGRRPARCYRQIKNKPYPKSRYCRGVPDPKIRIFDVGQKKRSADDFPLCVHLVSWEKENVSSEALEAARIACNKYMAKHAGKDAFHLRVRAHPYHVLRINKMLSCAGADRLQTGMRGAFGKPTGTCARVRIGQVLLSVRCRDAHAAHAQEALRRAKFKFPGRQRVIFSAKWGFTRFKRDEYLKLKSEGRIVPDGVNAKLLTRHGSVADRQPGRGVFPPSVAGSAA

SEQ ID NO: 29786 - protein, 375 aa, Brucella ovis
MKIDYYEALGVTRTADDKTLKAAFRKLAMQYHPDRNPDDPEAERKFKEIGEAYETLKDPQKRAAYDRFGHAAFENGGMGGGFGNGFAGAGGFADIFEDIFGEMMGGRRRRNGAERGADLRYNMEVTLEEAYAGKTAQIRVPTSITCDECSGSGAKPGSQPTTCTMCSGSGRCRAAQGFFSVERTCPGCNGRGQIIKDPCKKCHGQGRVDRGRSLSVNIPAVSRTEPRIRLAGEGEAGLRGGPAGDLYILLSVKPHEFFQRDGADLYCKVPISMTTAALGGQFEVSTLDGTQTRVKVPEGTQNGKQFRLKGKGMPGLRQSVTGDLYIQIDIETPQNLSKRQRELLEEFEKLSWQENSPKSAGLFSRMKEFFEGIGE

SEQ ID NO: 29787 - protein, 499 aa, Brassica napus
MGKVAVGATVVCAAAVCAASVYIVRRRMQSSGKWARVIEILRVLEEDCATPIGKLRQVADAMTVEMHAGLASEGGSKLKMLISYVDNLPSGEEHGFFYALDLGGTNFRVMRVLLGGKQGRVVKQEAKEVSIPPHLMTSGSDELFNFIAEALANFVATEGEDFHLPEGRQRELGFTFSFPVKQTSLSSGTLIKWTKGFSIEDTVGQDVVGELVKAMERVGLDMNVTALVNDTVGTLAGGRYYNPDVVAAVILGTGTNAAYVGRAHAIPKGQGLLPKSGEMVINMEWGNFRSSHLPLTEYDHLLDFDSLNPGEQILEKIISGMYLGEILRRVLLKMAEEAAFFGDSIPPKLKVPFIIRTPTMSAMHSDTSPDLKVVGSKLKDILEVPTTLKMRKVVISLCNIIATRGARLSAAGIYGILKKLGRDAPKDGEATQKSVIAMDGGLFEHYTQFSECMESSLKELLGDEASGSVEVIHSNDGSGVGAALLAASHSQYLEDSETS

SEQ ID NO: 29788 - protein, 358 aa, Unknown
  Acinetobacter sp. ADP1
MFIKNAWYVACRPEEIQDKPLGRTICGEKIVFYRGKENKVAAVEDFCPHRGAPLSLGYVEDGHLVCGYHGLVMGCEGKTIAMPAQRVGGFPCNKAYAVVEKYGFIWVWPGEKSLANEADLPTLEWADHPEWSYGGGLFHIQCDYRLMIDNLMDLTHETYVHSSSIGQKEIDEALPVTKVDGDHVVTERYMENIIAPPFWQMALRGNHLADDVPVDRWQRCHFFAPSNVHIEVGVAHAGHGGYNAPKDKKVASVVVDFITPETETSHWYFWGMARNFQPENQQLTDQIREGQGKIFTEDLEMLEQQQQNILRNPQRQLLMLNIDAGGVQSRKIIDRLLAKENSPSPQDTQRKFPNIRVI

SEQ ID NO: 29789 - protein, 829 aa, Solanum lycopersicum
MSGRRSSYTLLNQIPNDNFFQPPAPKFSAGAGVVPYGESSSAEKNRGKVFDLDLMDQRMMQSHNRVGSFRVPGSIGSQRQSSEGSFGGSSLSGENYVGTSFGHKNEGCGSSVARSWAQQTEESYQLQLALAIRLSSEATCADSPNFLDPVTDVLASRDSDSTASAVTMSHRLWINGCMSYFDKVPDGFYWIYGMDPYVWALCSVVQESGRIPSIESLRAVDPSKAPSVEVILIDRCNDLSLKELQNRIHSISPSCITTKEAVDQLAKLVCDHMGGAAPAGEEELVSMSKGCSNDLKDRFGTIVLPIGSLSVGLCRHRALLFKVLADIIDLPCRIAKGCKYCNSSDASSCLVRFEHDREYLVDLIGKPGVLSEPDSLLNGPSSISIPSPLRFPRYRQVEPTTDFRSLAKQYFLDSQSLNLLFDDSSAGAAADGDAGQSDRSCIDRNNVVSSSSNRDEISQLPLPPLNAWKKGRDKESQLSKMYNPRSMLNPVNMDEDQVLVKHVPPFREDAQSPMTRPDTVNDTRFLAGGGHVVSAIPSEELDLDVEEFNIPWNDLILMEKIGAGSFGTVHRGDWHGSDVAVKILMEQDFHAERLKEFLREVAIMKRLRHPNIVLFMGAVIQPPNLSIVTEYLSRGSLYRLLHKPGAREVLDERRRLCMAYDVANGMNYLHKRNPPIVHRDLKSPNLLVDKKYTVKICDFGLSRFKANTFLSSKTAAGTPEWMAPEVIRDEPSNEKSDVYSFGVILWELATLQQPWNKLNPPQVIAAVGFNRKRLDIPSDLNPQVAIIIEACWANEPWKRPSFSTIMDMLRPHLKSPLPPPGHTDMQLLS

SEQ ID NO: 29790 - protein, 72 aa, Prosthecochloris aestuarii
MAKEDSIEVEGVILEALPNAQFKVELENGLEILAHVSGKIRMHYIRILPGDKVKVQISPYDLTKGRITYRYK

SEQ ID NO: 29791 - protein, 303 aa, Agrobacterium sp.
TRQMILAVGQQGPIARAETREQVVVRLLDMLTKAASRGANFIVFPELALTTFFPRWHFTDEAELDSFYETEMPGPVVRPLFEKAAELGIGFNLGYAELVVEGGVKRRFNTSILVDKSGKIVGKYRKIHLPGHKEYEAYRPFQHLEKRYFEPGDLGFPVYDVDAAKMGMFICNDRRWPEAWRVMGLRGAEIICGGYNTPTHNPPVPQHDHLTSFHHLLSMQAGSYQNGAWSAAAGKVGMEENCMLLGHSCIVAPTGEIVALTTTLEDEVITAAVDLDRCRELREHIFNFKQHRQPQHYGLIAEL

SEQ ID NO: 29792 - protein, 112 aa, Unknown
  Synechococcus sp. CC9311
MKKVEAVIRPFKLEDVKLALVNAGIVGMTVSEVRGFGRQKGQVERYRGSEFTVEFLQKLKVDVVIDDDRVEAVINAIAEAAKTGEIGDGKIFVSSVDTVVRIRTGDRDSSAL

SEQ ID NO: 29793 - protein, 526 aa, Arabidopsis thaliana
MGLQNMLVVREGNDTPGCGRLISDATELLVFRSPNDSEAFRCLVDKISSSERRFCAGVKSTKRPDINKDIPANGSSNENQPLAVLPTNESVFNLHRGGMRRRCLDFEMPGKRKKDIVDDQQSVCDNNVAGESSSSCVVPGIGLHLNAVAMSAKDSNISVIHGYSISGEIQKSFSGSTTPIQSQDTVQETSDQAENEPVEEVPKALVFPELNLGSLKKKMRKSEQAGEGESCKRCNCKKSKCLKLYCECFAAGVYCIEPCSCIDCFNKPIHEETVLATRKQIESRNPLAFAPKVIRNADSIMEASDDASKTPASARHKRGCNCKKSNCMKKYCECYQGGVGCSMNCRCEGCTNVFGRKDGSLLVIMESKLEENQETYEKRIAKIQHNVEVSKEVEQNPSSDQPSTPLPPYRHLVVHQPFLSKNRLPPTQFFLGTGSSSFRKPNSDLAQSQNEKKPLETVTEDKTEIMPEILLNSPIANIKAISPNSKRVSPPQPGSSESGSILRRRGNGRKLILRSIPAFPSLNPNQ

SEQ ID NO: 29794 - protein, 834 aa, Arabidopsis thaliana
MAPERVRVFLWLVVQQVIITNVERYRRHLSDTRVCQICQGGEETILHVLRDCPAMAGIWSRLVPRDQIRQFFTASLLEWIYKNLRERGSWPTVFVMAVWWGWKWRCGNIFGGNGKCRDRVKFIKDLAEEVAIANAFVKGNEVRVSRVERLVSWVSPEDGWVKLNTDGASRGNPGFATAGGVLRDHNGAWIGGFAVNIGVCSAPLAELWGVYYGLFIAWGRGARRVELEVDSKMVVGFLTTGIADSHPLSFLLRLCYDFLSKGWIVRISHVYREANRLADGLANYAFSLSLGKKKKFKNKKQEVGSSSELLSYVFSLLSSLFLSLSELFRRPPLITFFSTIETIKSIQGFTQFLMLVLIVSFPEREKLRLLESAQKISRPARILIEMECIELNMAIIQLGSTCVAQWSIRPQFAVRAYYPSRIESTRHQNSSSQVNCLGASKSSMFSHGSLPFLSMTGMSRNMHPPRRGSRFTVRADADYYSVLGVSKNATKAEIKSAYRKLARNYHPDVNKDPGAEEKFKEISNAYEVLSDDEKKSLYDRYGEAGLKGAAGFGNGDFSNPFDLFDSLFEGFGGGMGRGSRSRAVDGQDEYYTLILNFKEAVFGMEKEIEISRLESCGTCEGSGAKPGTKPTKCTTCGGQGQVVSAARTPLGVFQQVMTCSSCNGTGEISTPCGTCSGDGRVRKTKRISLKVPAGVDSGSRLRVRGEGNAGKRGGSPGDLFVVIEVIPDPILKRDDTNILYTCKISYIDAILGTTLKVPTVDGTVDLKVPAGTQPSTTLVMAKKGVPVLNKSNMRGDQLVRVQVEIPKRLSKEEKKLIEELADMSKNKTANSTSR

SEQ ID NO: 29795 - protein, 458 aa, Aspergillus nidulans
MEDRLVDTDPEVAKIMENEIQRQRESVVLIASENFTSRAVFDALGSPMCNKYSEGYPGARYYGGNQHIDAIELLCQSRALKAFNLDADKWGVNVQCLSGSPANLQVYQALMRPHDRLMGLDLPHGGHLSHGYQTPSRKISAVSTYFETFPYRVNLETGIIDYDTLEANAELYRPKILVAGTSAYCRLIDYARMRKIADKVGAYLVVDMAHISGLIAAGVIPSPFEYADVVTTTTHKSLRGPRGAMIFFRKGVRSTDPKTGKDIMYDLEGPINFSVFPGHQGGPHNHTITALSVALKYAATTEFKQYQEQVIKNAKALENEFKAIGHKLVSDGTDSHMVLVDLRPKSLDGARVEAVLEQINIACNKNSIPGDKSALTPCGIRIGAPAMTSRGMGEEDFKRIARYIDQAINICKSVQAALPTDANKLKDFKAKVASGTVPEINDLRKEIAAWASTFPLPV

SEQ ID NO: 29796 - protein, 466 aa, Xylella fastidiosa
MTVASVEQMFSGKIQVGSEVTVRGWVRTRRDSKAGLSFVSVSDGSCFAAIQVVTPAHLPNYETEVRKLTTGCAVIVIGTLALSLGQGQQFEIQAQSIEVVGWVEDPETYPIQPKQHSLEFLREVAHLRPRTNLFGAVARIRHCLSQAVHRFFHENGYYWITTPIITTSDAEGAGQMFRVSTLDLVNLPRTETGGIDFSHDFFGKETFLTVSGQLNVEAYALALSKVYTFSPTFRAENSHTPRHLAEFWMIEPEIAFADLAEDARVAEQFLKFLFKTVLEERDDDLAFITERVEKTTISKLEGFINSPFERIEYTDAIKLLERSGKKFDFPVEWGLDLQTEHERWLTEKHIGRPVVVTNYPEHIKAFYMRLNDDGKTVAAMDVLAPGIGEIIGGSQREERLEMLDIRMAQFGLDPAHYQWYRDFRRYGSVPHAGFGLGFERLVVYVCGLSNIRDAIPYPRAPGSAEF

SEQ ID NO: 29797 - protein, 348 aa, Mycobacterium leprae
MQDEGMRIGILTGGGDCPGLNAVIRAIVRTCDARYGSSVVGFQDGWRGLLENRRMQLCNDDRNDRLLAKGGTMLGTAHVHPDKLRAGLHQIKQTLDDNGIDVLIPIGGEGTLTAAHWLSQEDVPVVGVPKTIDNDIDCTDVTFGHDTALTVATEAIDRLHSTAESHQRVMLVEVMGRHAGWIALSSGLASGAHMTLIPEQPFDVEEVCCLVKRRFQRGDSHFICVVAEGAKPVPGSITLRQGGMDEFGHERFTGVAAQLGAEVEKRINKDVRVTVLGHVQRGGTPTAFDRVLATRFGVNAADASHAGEYGQMVSLRGQDIGRVPLEDAVRQLKLVPESRYDDAAAFFG

SEQ ID NO: 29798 - protein, 449 aa, Mycoplasma hyopneumoniae
MFQTINEISIHPELYNQKKVLIQGWITNIRGNLKIIFVELNDGSSFKNLQCVLKKEFIDFDKIENLALGVAVEISGIFSNTPERQQFGEVLVETLEIKGNNYNTNFPIQNQEISLEVLRQMPHFRHRSRLFRVIMKLRSALFFEIHKFFRRQGFINFSAPILTSNDGEGAGEVFIVDDENKDFFNKKTTLGVTGQLHAEAYALGFKKVYTFAPTFRAERSNTRRHAAEFWMIEPEVAFFTLEQIIELAVKLLQKVIKSVIIRNKDEFIFLEKAGDKNLRKRLLQFCDSQVTQISYEKAIELLLEHQEKFEEKDLFFGCDLKTEHERFLTEEIFHMPVVIINYPKNLKAFYMHQNEDGQTVAAFDLLVPGIGELIGGSQREVRYEKLLARMNELNMNIEEFQWYLDLRKYGNPGSSGFGLGFERLLMYITGIENIRDVIPFPRTNKNILM

SEQ ID NO: 29799 - protein, 313 aa, Streptococcus pyogenes
MTKIYKTITELVGQTPIIKLNRLIPNEAADVYVKLEAFNPGSSVKDRIALSMIEAAEAEGLISPGDVIIEPTSGNTGIGLAWVGAAKGYRVIIVMPETMSLERRQIIQAYGAELVLTPGAEGMKGAIAKAETLAIELGAWMPMQFNNPANPSIHEKTTAQEILEAFKEISLDAFVSGVGTGGTLSGVSHVLKKANPETVIYAVEAEESAVLSGQEPGPHKIQGISAGFIPNTLDTKAYDQIIRVKSKDALETARLTGAKEGFLAGISSGAALYAAIEVAKQLGKGKHVLTILPDNGERYLSTELYDVPVIKTK

SEQ ID NO: 29800 - protein, 172 aa, Pyrus pyrifolia
MKKASEPPVVGRVIGDVLDSFTATTKMSVTYNTKLVCNGLELFPSVVTAKPRVEIQGGDMRSFFTLVMTDPDFPGPSDPYLREHLHWIVTDIPGTTDATFGREVVSYEMPKPNIGIHRFVFVLFKQNRRQSINTPSSRDHFSTRSFAAENDLGLPVAAVYFNAQRETAARRR

SEQ ID NO: 29801 - protein, 172 aa, Pyrus communis
MKRASEPLVVGRVIGDVLDSFTATTKMSVTYNTKLVCNGLELFPSVVTAKPRVEIQGGDMRSFFTLVMTDPDFPGPSDPYLREHLHWIVTDIPGTTDATFGREVVSYEMPKPNIGIHRFVFVLFKQNRRQSINTPSSRDHFSTRSFAAENDLGLPVAAVYFNAQRETAARRR

SEQ ID NO: 29802 - protein, 662 aa, Sinorhizobium meliloti
MPTTGIPPLGVTRTPDGTRFTVWSHNAARIDLCLFDEAGNTELSRLPMQRDGDVHSIALPDIAAGTRYGLRAEGVYSPDHGLWFDPSKLLVDPYAAQLDRPFRHDQRLTVFGEETADLVPKAILTEVKPLEPRPPLFQAGGLIYEIAVKPFTILHPGVPERKRGTVAALAEPVIIDHLTSLGVSAVELMPVVAWIDERHLPPLGLHNGWGYNPIAPMALDPRLVPGGIEELRRTVEVLHQAGIGVVLDLVFNHSGESDRFGATLSMRGLDNLTYYRHAAGRPGELINDTGCGNTIACDHPVVQRLILDSLRHFVLAAGVDGFRFDLASILGRDMGGFRRDAALFSAISADPILCGRVLIAEPWDTGPGGYQLGNFPHSFLEWNDRARDDIRRYWRGDRHAIGVLATALAGSSDSFSRWGETATRSVNFIAAHDGFTLMDLVSYARKHNEANGEGNRDGHDENFSWNNGAEGATGDPEIAAFRQRDVMALLGTLFTSRGAIMLTAGDEGGRSQGGNNNAYAQDNAVTWLDWSKLDGKLVEHTARLSAMRRRFSVFGDTGFFTGNGDVAWLRLDGEPLTVEDWEHPATDNLVVMLATEDRRQKRPTRLAVVINRSHAPHPFRLPLSLEGEWRDALSDLTVPSFAPARSVTFLVEVFESISRKRI

SEQ ID NO: 29803 - protein, 178 aa, Selaginella remotifolia
FLSGLKEERVQAAEVYKKLGLAGRLGGNVKVDKQQLVDDVRKALYASKICSYAQGMNLIRAKSLQKGWNLNLGELARIWKGGCIIRAIFLDRIKKAYDRNPGLENLLIDPEFAAEMVERHEAWRGVQMKAVQAGVPVPGISASIAYFDAYREGRLPANLVQAQRDYFGAHTYERTDMA

SEQ ID NO: 29804 - protein, 170 aa, Glycine max
  misc_feature (130)..(130): Xaa can be any naturally occurring amino acid
METQKKTREHSLHHIVDDIGAAFGMGAIGGSVVHFIKGTQNSPKGRRFVGGAQAVSMNAPRIGGSFAVFGGLFSAFDYTMVYIRKKEDPWNSIVAGAATGGFLSMRQGLAAASRSALMGGLLLALIKGVXLMLNKLAYWIVFIELSLLSLGTYILFCLNHSTVIHVLVVY

SEQ ID NO: 29805 - protein, 522 aa, Unknown
  Synechococcus sp. WH 7803
MLGELWSFQGRYRTLHLTWFAFFLTFVVWFNLAPLATTVKADLGLTVGQIRTVAICNVALTIPARVLIGMLLDKFGPRLTYSTLLVFSVIPCLMFASAQDFNQLVVARLLLSIVGAGFVIGIRMVAEWFPPKEIGLAEGIYGGWGNFGSAFSALTLVGLAGWLSFSGGFTLPTGDVLNWRGAIALTGIISAVYGVIYYFNVSDTPPGKVYQRPERTAGLEVTSMRDFWGLLGMNVPFAAILCVLCWRLQKVGFLNASTYPLALLAVLVWFVFQTWGIIRTNRDLIMGTKVYPKEDRYEFKQVAILELTYIVNFGSELAVVSMLPTFFETTFDLPKATAGILASCFAFVNLVARPAGGLISDKLGSRKNTMGFLTAGLGVGYLIMSLIKPGTFTGTTGIVIAVLITMLASFFVQSGEGATFALVPLVKRRVTGQVAGLVGAYGNVGAVTYLTIFSLLPLWMGGAGEPTAETIAASNSAFFQILGIAGLIVAFFCFFFLKEPKGSFAELHEGETAAEGTPSMAR

SEQ ID NO: 29806 - protein, 320 aa, Enterobacter cloacae
MIKKIGVLTSGGDAPGMNAAIRGVVRAALTEGLEVFGVYDGYLGLYEDRMVQLDRYSVSDMINRGGTFLGSARFPEFRDEHVREVAIENMKKRGLDALVVIGGDGSYMGAKRLTEMGFPCIGLPGTIDNDIKGTDYTIGFFTALGTVVEAIDRLRDTSSSHQRISIVEVMGRYCGDLTLAAAIAGGCEFIVVPEVEFSREDLVAEIKAGIAKGKKHAIVAITEHICDVDELAKYIEAETKRETRATVLGHIQRGGSPGPYDRILASRMGAYAIDLLLQGHGGRCVGIQNEKLVHHDIIDAIENMKRPFKGDWLDCAKKLY

SEQ ID NO: 29807 - protein, 229 aa, Unknown
  Synechococcus sp. WH 7803
MVTTPDAFGIGGFSIHWSAAMPPTTASVQSQCPYCGVGCGLDLLPPGEAGKAVKRDAEGNPMWSARGHREHPSSHGQVCIKGATVGETLGQGRLSQPLYRATLTDPFEAISWNSAFDLLTERIQSTLASKGADAIAMYGSGQFHTEDYYIAQKLLKGALGTNNFDANSRLCMSSAVAGYTRSLGSDGPPCCYEDLDHCSVVILIGTNTAECHPVLFQRLLKRKKRDPSL

SEQ ID NO: 29808 - protein, 967 aa, Unknown
  Azoarcus sp. BH72
MLTKKSSTAAGSGRRLRSSAARSLGQTMDRRTFLKRSGLGVGAGAIAAQLPYNLIGSAEAAASADNRLAGGEEVKRTVCTHCSVGCAVDAVVKNGVWVRQEAVFDSPINLGSHCAKGASVREHGHGEHRLKYPMKLVDGKYQKISWEQAINEVGDRLLKIREESGPDAVYWIGSSKHNNEQAYLLRKFVSFWGTNNCDHQARICHSTTVAGVANTWGYGAMTNSYNDMQNAKAMLFIGSNAAEAHPVSLLHILHAKENGAKMVVVDPRFTRTAAKADYYVRIRSGTDIPFIWGVLYHIFKNGWEDKQYIHDRVFGLEKVKEEVMKWTPDKVTEVTGIAEEQVFKVAETMAKNRPSTVVWCMGQTQHTVGNANVRAMCILQLVLGNVGVSGGGTNIFRGHDNVQGATDVGPNPDSLPGYYGLAAGSWKHWAAVWGVDYEWIKGRYASQAMMEKSGITVSRWIDGVLEQNELIDQDSNLRAVVYWGHAPNSQTRGIEMVEAMKKLDTLVVIDPYPSATAAMAAMVRKDGVYLLPAATQFETYGSCTASNRSIQWREKVIEPLFESKPDHTIMYAFAKKFGWAEQLVKNIKVAKDKQGWEEPDIEDTLREINRGTWTIGYSGQSPERLQAHMKNMHTFDVKTLKAVGGPCDGDYFGLPWPCFGNPEMKHPGTPNLYDTSKHVMDGGGNFRANFGVEKDGVSLLAEDGSASKGADLQMGYPEFDHVLMKKLGWWDELTEDEKKAAEGKNWKTDLSGGIIRVVMKNHGCHPFGNAKARAVVWNFPDPVPLHREPIYSPRPDLVEKYPTHADKMAFWRLPTLYKSLQDKVKDISRDYPLVMTSGRLVEYEGGGEETRSNPWLAELQQEMFAEVNPKDANNAGFRNGDYIWVETPSKAKLKVRAQVTERVGAGTVFLPFHFSGWWQGKDMLEHYPEGAAPIVRGEAVNTATTYGYDSVTMMQETKTTLCRVSKA

SEQ ID NO: 29809 - protein, 591 aa, Mesorhizobium loti
MPAFFCYQLDAGHTVCCPSAIAVRRCLDATPTIAHGSPNSRNRAMQAAIFVLVVLVFVAVSGALVRLVRVPLPVLQIAIGAALAWPVRGIHVEIDPELFLLVFIPPLLFSDAFGAPKRELMALRGPILDLAIGLVFFTIVGFGYALHWLVPSIPLVVAFALAAVLSPTDAVAVSSIVDRNVVPARLMHILEGESLLNDASGLVMFRFAVAAALTGSFSFAAASLSFLYAVAAGIVAGVAALFVAAKALQLLNRIGGVPAEPQVLITILLPFVAYLGAENFGASGILAAVTAGLLTGSTGIFRFLGVSARMQTISLWTTFSFVFNGALFIVLGLQLPEIIRKVPPELSSRHWLLEPVLTVLLLTLCLIALRFVWIWIGDITAGFAARLGKRKAEPFGLRVRLAGSVAGVRGAITLAGILSLPLALQDGSPFPARDLVIFLAAGVIICSLLIASLALPVIARGLVEPGEDAGAAEERMARVGAAKAAIAHLESLAQTDEEEGDVPGLKLAAANGIVAAYRRRIAASDEADEARAEMREAGRLETDLRLAGIAAERDALRAMLRRGEINDHTARALFTEITLSEALLNGRQTRK

SEQ ID NO: 29810 - protein, 437 aa, Mesorhizobium loti
MATAAAASNKFESFFETTLEDADPEIFGAIRNELGRQRHEIELIASENIVSRAVLEAQGSIMTNKYAEGYPGKRYYGGCQFVDVAEELAIERAKKLFGCNFANVQPNSGSQMNQAVFLALLQPGDTFMGLDLNSGGHLTHGSPVNMSGKWFKVVSYGVRKEDHLLDMDAIEKTAHETKPKLILAGGTAYSRIWDWKRFREIADAVGAYLMVDMAHIAGLVAGGVHPSPLPHAHVVTTTTHKSLRGPRGGMILCNDEDIAKKMNSAVFPGLQGGPLMHVIAAKAVAFGEALKPSFKVYAESVAANAKALASSLKETGLDIVSGGTDNHLMLVDLRPKNATGKRAEAALGRANITCNKNGIPFDPEKPFVTSGVRLGTPAGTTRGFGQAEFREIGKLIAEVLDGLKIANSDEGNAAVEAAVKAKVVALTDRFPLYPYLG

SEQ ID NO: 29811 - protein, 370 aa, Aspergillus awamori
MSNLPHEPEFEQAYKELASTLENSTLFQKNPEYRKALAVVSVPERVIQFRVVWEDDAGNVQVNRGFRVQFNSALGPYKGGLRFHPSVNLSILQVPWFRADLQECSHWPEHGWWYVEHMIAHATNGQESFKGKRVAISGSGNVAQYAALKVIELGGSVVSLSDTQGSLIINGEGSFTPEEIELIAQTKVERNELASIVGAAPFSDANKFKYIAGARPWVHVGKVDVALPSATQNEVSGEEAQVLINAGCKFIAEGSNMGCTQEAIDTFEAHRTANAGAAAIWYAPGKAANAGGVAVSGLEMAQNSARLSWTSEEVDARLKDIMRDCFKNGLETAQEYATPAEGVLPSLVTGSNIAGFTKVAAAMKDQGDWW

SEQ ID NO: 29812 - protein, 353 aa, Unknown
  Acinetobacter sp. ADP1
MTTMNAIYQHASSTEQYLDLGLRDQWYPVLASWEVSANPVGITRLGENIVVWRDEAGQLYALEDRCPHRGARLSLGWNLGDRVACWYHGVEVGGDGVVADVPAVHECPLKGAACVKSYPIIEKHDAIFIWFGIDANEPPAELVFPEQLASEAWSSFLCQADWKVNHQYAIDNVMDPMHGTYLHCTSHSMAEGERTAEMKHRSTEHGFIFEKEGQTGVNFDWVEYGNTGASWLRLSIPYRKDFGPGGVFWIVGFATPIDADNTRVFFWRCRKVNGWQRNVWRFLYRNHLEKLHWDVLEQDRIILENLAPNARSKEFLYQHDVGLSRLRRLMKKEAEKQLKKIAVLNTSSLTETP

SEQ ID NO: 29813 - protein, 553 aa, Vibrio vulnificus
MFCIQCEQTIQTPAVKGCSFAQGMCGKTAEVSDLQDVLVYSLQGVSYWATQAHRYGIINDEINQWAPKAFFSTLTNVNFDPERILQLTSQAAQFKAQLKDQVLTASSLANSPLSEVPAVAEFELPENAQAILAFAPQVAVNRGKEGVHEDVIGLRLLCLYGLKGAAAYMEHARVLEQTNNDIYAEYHEIMAWLGTDPEDLGELLDCSMRIGLMNYKVMEMLDHGETATFGHPVPTAVNVKPVKGKCILVSGHDLHDLEKILQQTEGKGINVYTNGEMLPAHGYPELNKYPHLVGNYGSAWQNQQKEFANFPGAIVMTSNCLLNPNVGQYADRLFTRSIVGWPGVAHIEDDDFSAVIESALAQPGFQHDEIEHMITVGFGRNALMNAAPAVIDQVKQGNIKHFFLVGGCDGDKAERSYYTDFTEAAPEDTLILTLACGKFRFNKNTFGDINGIPRLLDVGQCNDAYSAIQLALALAQEFDCGINELPLTLVLSWFEQKAIVILLTLFALGVKGIYTGPTAPAFLTPNLIAIIQEKFDMRSIGNVQDDLNTILAA

SEQ ID NO: 29814 - protein, 547 aa, Glycine max
MKMGSRSGGLVCSTCSYTGIRTRRFYTNNNTFPSFSFTFPHQPQSFSFPKPLRLMSQPLTTNSADGDSSVAAPPILFDYHLIDQKLLQNIVYDALVWSTLNCLLVGDKSVQRSGTVPGVGLVHLPLSLLPGPFPENHWKQACELAPIFNELVDRVSLDGKFLQESLSRTKNADEFTSRLLDIHSKMLQINKKEDIRMGIVRSDYMIDEKTKSLLQIEMNTISTSFALIGCLMTGLHKSLLSQYGKFLGLDSNRVPANNAVDQSAEALAKAWSEYNNPRAAILVVVQVEERNMYEQHYISALLREKHHIRSIRKTLTEIDQEGEILPDGTLSVDGQEISVVYFRAGYTPKDYPSESEWRARLLMEQSSAIKCPTISYHLVGTKKIQQELAKPGVLERFVENKDHIAKLRACFAGLWSLEDSDIAKKAIENPELFVMKPQREGGGNNIYGDELRETLLKLQEAGSEEDAAYILMQRIFPATSPAILVRDGNWDKGHVISEAGVFGTYLRNKDKVIINNESGYMVRTKISSSYEGGVLPGFGVVDTVYLT

SEQ ID NO: 29815 - protein, 551 aa, Gibberella zeae
MSAEAPAQDAPQQESRARKDSFSGKSQTSETSQTAAEFIRSQEALEADAREALPYSIDTCTKILGPLRQAVFACLTCNPPPAKEGDDWTPAGVCYACSIQCHGEHNLVEIFQKRNFTCDCGTKRIPSTSPCTLRLNEATNTRGGVHSEEPDVNNKYNHNFCNRFCGCHCDYDPFQQKGTMFQCLGLGTVETGGCGEDWYHPGCLVGMGPNWFEKMEKPKKTAPENNEEGKLTTIAEGNEEKQDPAQTAGQDKEKAAENAVEADEDEDEDVPMPPGFPEEDAFEAFLCYKCVEAHPWIKRYAGTSGFLPAVFLNQPDSEPKKEPESAKEESVHTTETAVAAEGGQDSRKRKADDDVEEPTDIKRIKSESQSGDEKPAEETTPTDKLPCKLKNLPPAPQGQFSLFLKEDFREAFCRCSSCYPHLNPHPQLLEEEEVYEPPLSDGGSQVDGDGGGSHGSGSLLERGESALRNVDRVRAIEGVMAYNHLKEQLKPFFQQFAESGQAIGAEDIKAYFAKLRGDEKGIEEAAAGAKDGEGSGSGSGDGDNRKEQSGF

SEQ ID NO: 29816 - protein, 604 aa, Corynebacterium diphtheriae
MTTTNSYTGQLGAFLTPHGDTCFRVWSPDAATADLLIENHTVSMHPIGDGVWEAKLDGDRHGQRYSYRLSLRGETIESVDPYARAVTANGTHGVVVTQSTPVPRMPAFTAPTDAIIYEAHVRDLSIAPNSGIHNKGRFLGLTERDTHTTAGNPSGLDYILSLGVTHIQLLPIFDFGSVDETGDLSYNAQYNWGYDPMNYNAPEGSYSSNPNDPFTRIDELKHTIRTLHDAGLRVIMDVVYNHVYDTTTSPLERTAPGHYFRMTDDGTFHDGTFCGNETASENPMMRKFIIDSVTHWATEYGLDGFRFDLMGIHDVDTMNAIRTALDAIDPSIIILGEGWNLGNHPPHILPANQHNAAHMPRIAHFNDSLRDTLKGSTFHSNSRGLLTGDHNPKHMWTLFNNIKGAQHLPGLNFTSANHTVNYIEAHDNHTLYDRLHLLLPDAPHDELIRRCQLATTIQYLACGITFIHAGQEFARTKNNTENSYNSPDHINAIDYDRAAQHPHSVQLLRDLNNFRKTHTELFPTEYDDINELYEATLVSGDFLTYSVGKQTTVAINFSTQPRSIPTEGYFAVLLDDHVFPTDKQIETNSWTVAPLSVSILQQVS

SEQ ID NO: 29817 - protein, 257 aa, Unknown
  Synechococcus sp. CC9311
MTGTVYLVGAGPGDPDLLTVKAHRLLQCCDALVYDSLVPSEVLELVPETCERHFVGKRRGHHSVPQPSTNSVLVALGQRYKTVVRLKGGDPFLFGRGGEEAAHLVSHGVAVEVVPGVTAGIAAPAYAGIPVTHRRAGSSVTFVTGHEEIDKRRPSVNWRALATASDGLVIYMGLHNLPRIAEELIAGGLDGDTPVAVVQQGTVVGQRCLKAPLREVAEATRLEQFASPSIVVVGDVVNQQVSACAPEPAAVTMPIPF

SEQ ID NO: 29818 - protein, 197 aa, Xanthobacter autotrophicus
MRKADIVRETKETRVALTVDLDGTGRSAISTGIGFLDHMLDLLARHARFDLEIKADGDLHVDFHHTTEDVGIVLGQALKKALGDMRGITRYADVLLPMDETLTRVALDISGRPFLVFRTEFAVPKIGEFDTELVREFFQAFASSAGVTLHVETLYGVNAHHIAESCFKGLARVLRAAVAVDPAAAGEIPSTKGALGT

SEQ ID NO: 29819 - protein, 537 aa, Desulfitobacterium hafniense
MKGVNYSLSAERLQSFGEISLSKQVLQALSEMGFEEPSPIQKAAIPVAMDGLDLIGQAQTGTGKTAAFGIPICEKINPKFQAVQALILTPTRELAVQVSEEISKIGKYRHIKPLPIYGGQSIDRQIRALRFGSQVVVGTPGRILDHLNRGTLKLQYVKMVVLDEADEMLDMGFVDDIETILKQVPKEERQVMLFSATMPPEIKKLAQNYMSQPKSVAVSRDELTVPLIEQVFYETRDKIKVDALCRIIDMEDIGQAIIFCRTKRGVDELVAALEARGYFADALHGDLSQQQRDRVMKKFRDGKVELLVATDVAARGLDIDNVTHVINFDIPQDPESYVHRIGRTGRAGRKGQAITLVSSREYRQLRLIERLIKTRIVRKELPTLADVSERQAENLKNQLVKILQRSHLGTYRSIVGSLLEEYDSMDVAAAALKFAVEGVEERTEEEDELTFGNTGAAPGMVRLFMNIGRLQQVRPQDIVRWIADESGIPGNIIGMINIYDKFTFVEIPEQHASRVLSCMHQNMIKGRKVNVEPAKAR

SEQ ID NO: 29820 - protein, 454 aa, Unknown
  Synechococcus sp. CC9311
MGASENLVIVGSGPAGYTAAIYAARANLNPLLITGFQRGGIPGGQLMTTTHVENFPGFPDGVLGPDLMDLMKAQAERWGTHLIEADADVIDLSQRPYRIEAEGKTIQTQSIIIATGASANRLGLPNEERFWSQGISACAICDGATPQFRKEELAVVGGGDSACEEAVYLTKYGSQVHLLVRSDCLRASAAMADRVEANPQITVHWNTEVVDVEGTDWMNGLRLRNRDSGKEETLAVRGMFYAIGHTPNTELLKGQLDCDRSGYLVTKPGRPETSLEGVFAAGDVADAEWRQGITAAGSGCQAALAAERWLSHHDLATLVSREAVEPQKANAPQAIEATTESTYDANAEWQKGSYALRKLYHDSNKPLLVIYSSPSCGPCHVLKPQLKRVLSELNGQAQGVEIDIEADQEIAEQAGVNGTPTVQLFYGKSLQQQWRGVKQRSEFKGAIEALLKGQ

SEQ ID NO: 29821 - protein, 172 aa, Cydonia oblonga
MKKASEPLVVGRVIGDVLDSFTATTKMSVTYNTKLVCNGLELFPSVVTAKPRVEIQGGDMRSFFTLVMTDPDFPGPSDPYLREHLHWIVTDIPGTTDATFGREVLSYEMPRPNIGIHRFVFVLFKQNRRQSINTPSSRDHFSTRSFAAENDLGLPVAAVYFNAQRETAARRR

SEQ ID NO: 29822 - protein, 536 aa, Bradyrhizobium japonicum
MLIKRANQRSLRHGSVAESLAGQGGGLDRRSFLRKSGLAGGALAVLGTLPVGGVRKAEAAMAGPLTAGASVRKSVCTHCSVGCTVTAEVLNGVWIGQEPSWDSPINRGSHCAKGASVRELVHSERRLRYPMKLVGGQWTRVSWDTAINEIGDKLQTVREKSGPDSVYWLGSAKMTNEGAYLFRKLGAFWGTNNTDHQARICHSTTVTGVANTWGYGAMTNSFNDIRNAKTQVVLGGNPAEAHPVSLQHLLEGKELQKANFVVIDPRLTRTAAHATEYVRMRPGTDIPVLYGMMWHILQNGWEDKEFIRQRVYGFDDLRKEVEKWNPEEVERVTGIPGEQLKRVAKMFATEKPATLIWAMGQTQKTVGTANVRASCILLLMTGNVGGAGMGANIFRGHDNVQGATDVGLDIVTLPFYYGLAEGAWKHWSRVWEVDYDFLKSRFDSKQIMETPGIPLTRWFEAVTLPKDQVAQKDNVKAVFVQGHASNSITRIPESLNGLKALEAARHRRSASDDLGLARSRGGTQGWCLHSPGRHPI

SEQ ID NO: 29823 - protein, 137 aa, Arabidopsis thaliana
  misc_feature (53)..(53): Xaa can be any naturally occurring amino acid
ARNPGGAHRGPNRAKEEGNHQEVVWVSFMLSSAVGVTSPVKATMVVQLTGWKXSVEFPATRRTNRAIISIEGNGGGVSCLKGWPPIGKKKLGTLFNLPDLRDVKLVKEVDYLFRTRGIPGVEFKLKHGFGYRGHGTT

SEQ ID NO: 29824 - protein, 172 aa, Chaenomeles sinensis
MKRASEPLVVGRVIGDVLDSFTATTKMSVTYNTKLVCNGLELFPSVVTAKPKVEIQGGDMRSFFTLVMTDPDFPGPSDPYLREHLHWIVADIPGTTDATFGREVVSYEMPRPNIGIHRFVFVLFKQNRRQSINTPSSRDHFSTRSFAAENDLGLPVAAVYFNAQRETAARRR

SEQ ID NO: 29825 - protein, 662 aa, Chlamydophila caviae
MDKISFYPGSPLPLGATQLSSHRYRFALFSSQATQVVLALSDKNSHIQEIVLSHEKNRTGAVWHIEVEGISDQWSYAFRVDGPTNTTAKFDFKKYLADPYAKNLHSPQIFGSIKTSGDYAFSYLKNEEFSWEGDHCLNLPKEESIIYEMHVRSFTWNNSSKVCYPGTFLGIIEKIDYLKKLGINAIELLPIFEFDETHHPFRTADSSHLCNYWGYASVNFFSPCRRYAYGSDPCAPIREFKTLVKALHKAGIELILDVVFNHTGLDNTTCPLPWIDLSSYYMVNSQGEFANYSGCGNTVNTNYTPTTQWILDSLRYWVQEMHVDGFRFDLASVFSRDPLGNPVPFSPILQAISYDPVLSETKIIAEPWDAAGLYQVGYFPTLSPRWSEWNGQYRDTIKSFLNGDGHLIGTFASRISGSQDLYPQGSPCNSINYICSHDGFTLHDTVSYNSKHNEENGEENRDGSNANYSYNFGEEGETNNPTILALRERQMRNFLLTLFLSQGIPMLQSGDEYGHSAKGNNNRWALDTDTNHFLWDELSKNNALFDFVCNAIRFRKQHKEIFNQGFLTEENISWLDAQGNPMQWNPSKFLAYELKSPKYSLFTAFYTGEEKIEIHLPKLRENFLPYQKVADSFGFASESLSKQVSLDAHMMLVAISYANQAS

SEQ ID NO: 29826 - protein, 176 aa, Exiguobacterium sibiricum
MEKATFAGGCFWCMVTPFEELPGIHSIVSGYTGGHVDNPTYEQVKTGTTGHSEVVEITFDPALFSYERLLELYWPQTDPTDAGGQFQDRGTQYAPAIFYHTEEQRLAAIASRDALAATNRFKQPIVTRIEPAHAFYPAEEYHQDFHKKNPAHYKKDRKASGRDAFIDVAWKEEVTV

SEQ ID NO: 29827 - protein, 172 aa, Eriobotrya japonica
MTRALEPLVVGRVIGDVLDSFTATTKMSVTYNTKLVCNGLELFPSVVTAKPRVEIQGGDMRSFFTLVMTDPDFPGPSDPYLREHLHWIVTDIPGTTDATFGREVVSYEMPRPNIGIHRFVFVLFKQNRRQSINTPSSRDHFSTRSFAAENDLGLPVAAVYFNAQRETAARRR

SEQ ID NO: 29828 - protein, 195 aa, Triticum aestivum
  misc_feature (94)..(94): Xaa can be any naturally occurring amino acid
  misc_feature (125)..(125): Xaa can be any naturally occurring amino acid
  misc_feature (130)..(130): Xaa can be any naturally occurring amino acid
  misc_feature (144)..(144): Xaa can be any naturally occurring amino acid
  misc_feature (149)..(149): Xaa can be any naturally occurring amino acid
  misc_feature (161)..(161): Xaa can be any naturally occurring amino acid
EISRHSSVESIDICEIDQLVIDICKEFFPHLSVGFEDPRVQLHVGDAVEFLRNAPEGTYDAIIVDSSDPIGPAQELVEKPFFETIARALRPGGXLCNQAESMWLHTHLIQDMLSICRETFKGSVXYAWVXPTYPSGVIGSVCAXMATGXFLTPVIIESERXLTGRNRLYQNHMHVVFALQRELSHERQREYARHK

SEQ ID NO: 29829 - protein, 172 aa, Unknown
  Malus x domestica
MARVPEPLVVGRVIGDVLDSFTPTTHMSVTYNAKLVCNGLELFPSVVTAKPRVEIQGGELRSFFTLVMTDPDCPGPSDPYLREHLHWIVTDIPGTTDAAFGREALSYEMPRPNIGIHRFVFVLFKQKRRQSINIPSSRDCFSTRSFAAENDLGLPVAAVYFNAQRESAARRR

SEQ ID NO: 29830 - protein, 321 aa, Magnaporthe grisea
MARKGSGTWFTHVRGAIIVFPWVVWLLLIDISVSALLLIKSLFPNFTYDLSSALAWTVWRWIQWIFEDVNGARVTISGDPLPANGESAVIVANHVSWNDFYMVQAVAVRAGMLGRCRYFAKIQLRAVPFLGWGLWALGMPMVTRNWLRDRDELNRVFEGIVNRRWPTWLVSFSEATRFTPKKYEESKQWCATNGKPQPQHLLYPRTKGFIATVQHLRHASHVKAVYDLAIAYQKDGSWMVAPVFWDTLSVPGLSAPGPHGFRFHVHVRRFPIEELPRSDADLARWLEQRWLDKGEWLEGLRKRWAEEEKDEESRAMDGAKV

SEQ ID NO: 29831 - protein, 172 aa, Pyrus pyrifolia
MARVPEPLVVGRVIGDVLDSFTPTTHMSVTYNTKLVCNGLELFPSVVTAKPRVEIQGGELRSFFTLVMTDPDCPGPSDPYLREHLHWIVTDIPGTTDAAFGREALSYEMPRPNIGIHRFVFVLFKQKRRQSINPPSSRDCFSTRSFAAENDLGLPVAAVYFNAQREGAARRR

SEQ ID NO: 29832 - protein, 255 aa, Agrobacterium tumefaciens
MALPDFSMRQLLEAGVHFGHQTHRWNPKMKPYIFGDRNNIHIIDLAQTVPMLSRALQVVSDTVARGGRVLFVGTKRQASEIIADSAKRSAQYYVNSRWLGGMMTNWKTISNSIQRLRKVDEILNSEGSGYSKKERLTLEREREKLEKALGGIRDMGGVPDLMFIIDTNKEKIAIEEAKRLGIPVVAIIDSNCDPDHIDYPIPGNDDASRAISLYCDLIARAAIDGIARQQGASGRDIGASEEAPIEPALEDEAGA

SEQ ID NO: 29833 - protein, 174 aa, Schizosaccharomyces pombe
MGQSQSQIFEDLISNSSFSNEEIERIRKRFIKIDANQSGSIDRNEFLSIPSVASNPLASRLFSVVDEDGGGDVDFQEFINSLSVFSVHGNKEEKLKFAFKIYDIDRDGYISNGELYLVLKMMVGTNLREDQLQQIVDKTIMEVDKDRDGKISFEEFKDIVSGSNVTSSMTLDSF

SEQ ID NO: 29834 - protein, 274 aa, Unknown
  Oceanobacter sp. RED65
MTQTVITVGLVQMTSGKAVQPNLRAAEAAIKRCVEQGATTVLLPEMFVCLGVKNQVEIAQTQCQKGGPVRSQLSALAKDFKVNIIAGSMPLMSSVEDKVLAACLVFAADGSEVCQYDKVHLFDVDVSDNKGRYRESDTFIAGTQSKTVSLDGTLYGLSVCYDLRFPELYQQYQKQSCQVVTVPSAFTYTTGQKHWLTLLKARAIETQSFVMAANQVGTHEDGRITWGQSIVINPDGEIVGELDSEKAGELVVELDLELCQKIRQSMPLLKHKRL

SEQ ID NO: 29835 - protein, 165 aa, Campylobacter jejuni
MKNIILGGGCFWCIEAVFERLKGVINTEVGYSGGKPNPSYESVCNGDGNIEVVKINYDEKQISLLEILILFFKIHDPTSIDKQGEDIGIQYRSIIFYENEEDKILAQNFIEEQQKIFSKKIVTKISRLQTYYKAENYHQHYFINNPDQGYCQAVIAPKLQKIQSD

SEQ ID NO: 29836 - protein, 246 aa, Brassica napus
MDNNNQQPPPPPTSVYPPASAATAIPPPPPSGSTPIIPGGGGASYHHLLQQQLQQLQMFWSYQRKEIEQVNDFKNHQLPLARIKKIMKADEDVRMISAEAPILFAKACELFILELTIRSWLHAEENKRRTLQKNDIAAAITRTDIFDFLVDIVPREEIKEEEEAALGSMVAAPAVSGVPYYYPPMGQPAVPGGMMIGRPAMDPSGVYAQPPSQAWQSVWQNSAAGDDVSYGSGGSSGGHGNLDNQG

SEQ ID NO: 29837 - protein, 491 aa, Unknown
  Oceanobacter sp. RED65
MNTEILLNVTPTETRMGLVENGVLQEVSIERSNRRGIVGNIYKGKVVRVLPGMQAAFVDVGLERAAFIHAADIHGPAKDSEAAKRQPDAITSLVHEGQSLVVQVTKDPIGTKGARLTTHLSIPSRYLVFMPYSQHVGISQRIEDEGERDRLRKLVLSCMEAEGLSDECGFILRTAAEGAGEDEILMDTRYLQRVWGKVQERMKSADAPSVIYEELPLHLRTFRDFIRPEVDKVLIDSRENFSKAQEFAQSFVPEVENKLEYYPGERPIFDLYAVEDEIQKALERKVQLKSGGYLIIDQTEAMTTIDVNTGGFVGHRNLEETIFKTNLEAATVIGRQLRLRNLGGIIILDFIDMEDVEHQRQVLRMLEKVLEKDHAKTKISQVSELGLVEMTRKRTRESLGQMICEPCHHCDGRGTIKTAETICYEIFRELLREARAYDANGYLVLASQGVIDLFLDEESQSLADLENFIGKTIKLQVEPLYSQEQYDVILQ

SEQ ID NO: 29838 - protein, 317 aa, Rhodobacter sphaeroides
MRGKAMAETRHTRVLIIGSGPAGYTAAVYSARAMLNPLLIQGLQPGGQLTITTEVENWPGDREVQGPELMVRMEDHARAMGAEIVSDYISSLDLSQRPFTAQADSGMTYTADAVILATGAQARWLGLPSEERFKGFGVSACATCDGFFYRGKEVVVAGGGNTAVEEALFLTNFASKVTLVHRRDSLRAEKILQDRLFKHPKIEVLWNHTIEEVAGTEAPLGVTGIVARNVLTGETTEVPCEGFFVAIGHAPASELVKDQLELHHGGYVKVEPGTTRTSIPGVFAAGDLTDHVYRQAVTSAGMGCMAALDAERFLAGA

SEQ ID NO: 29839 - protein, 427 aa, Picrophilus torridus
MESIESILNDDFIGKTVTIHGWVYRIRSSGRITFIIIRDSTDIVQCVASSSLGERYNDISSLTIESSLEVTGQVSKDERAVTGYEIKISDFKIYQRNEFFPITKDKSDEFLLDNRHLWLRSREFTSILKIRSTVFKAFADFFYNNGYYQVQGPMMVSTATEGGATLFKLKFFDDDVYLTQSSQFYLETMIFSLEKVFTIAPSFRAEKSRTRRHLSEYWHAEGEAAWLHNDDMMNVEEKMIEYIVSEVLNKNEKDLKLINRDISKLERIKAPFPRIKYRDLINKSREFGMNLKYGDDLGADEEYNIMIHYEKPLFVTNYPEELKTFYHLPDPENPGEILCHDLLAPEGYGEIIGGGERIWRLDELLERMKKAGLPEEDYYWYIDLRRYGSVPHSGFGLGLDRLVNWICNLNNIRDAIPYPRTVRRIKP

SEQ ID NO: 29840 - protein, 508 aa, Ralstonia metallidurans
MRDWRSQWVLPRGSASSLGVIFDAPAARLGSEWEAGCALHRLVAFSRPRCWTPVPSPRALIRENPAIQSSVDRHPVFVPAVPSALPFKQTSHAMFERSRFTIEQIDPEVFAAIQKENQRQEDHIELIASENYTSPAVMAAQGSQLTNKYAEGYPGKRYYGGCEYVDVVEQLAIDRVKQLFGAEAANVQPNSGSQANQGVFFAMLKPGDTIMGMSLAEGGHLTHGMALNMSGKWFNVVSYGLNAQEDIDYDALEKLAHEKKPKLIIAGASAFALRIDFERIAKVAKAVGAYFMVDMAHYAGLIAAGVYPNPVPHADFVTTTTHKSLRGPRGGVILMKAEHEKAINSAIFPGIQGGPLMHVIAGKAVAFKEALQPDFKAYQEQVVKNAAALAETLIARGLRIVSGRTESHVMLVDLRAKKITGKEAEKILGDAHITVNKNAIPNDPEKPFVTSGIRLGSPAMTTRGFKEEEARQVANLIADVLDNPHDEANIAAVREQVAALTRRFPVYG

SEQ ID NO: 29841 - protein, 554 aa, Unknown
  Shewanella sp. ANA-3
MFCIQCEQTIRTPAGNGCSYAQGMCGKLAATSDLQDLLIYMLQGVSVYATKARELGVINPEVDTFVPKAFFSTLTNVNFDDERIIAYAKQAAEYRESLKNAYEAACEAAGKRAESLPPVAQFVLGTSKPEMLSQAPVALLNKDKNEIHEDILGLRLLCLYGLKGAAAYMEHARVLGKTDAEIAGRFHEIMAFLGEPSVDADKLFTTAMDIGQLNYRIMAMLDAGETEAFGHPEPTVVNTKPVKGKAILVSGHDMKDLELILEQTAGKGINVYTHGEMLPALAYPAFKKYAHLVGNYGSAWQNQQKEFANFPGAVVMTSNCIIDPNVGQYSDRIFTRSIVGWPGVTHVIGDDFSVVIDKALSLDGFQYDEIPHNITIGFARNALMAAAPTVVENVKNGSIKHFFLVGGCDGDKSERSYFTDLAKSAPKDSVILTLGCGKYKFNKLEFGDINGIPRLLDIGQCNDAYSAIQLAIALSQIFECDINELPLNLVLSWFEQKAIVVLLTLLSLGVKNIRTGPTPPAFLTANLAKILEEKFGLRNTTTVEADLKTMLNVA

SEQ ID NO: 29842 - protein, 450 aa, Bacillus licheniformis
MTHVRFDYSRALPFFKEQELTYLRDFVKVAHHTIHEKTGAGSDFLGWVDLPTDYDKEEFARIKKCAEKIQNDSDVLLVVGIGGSYLGARAAIEMLNHSFYNVLPKEKRKTPQVIFIGNNISSSYMRDVMDLLEDADFSINVISKSGTTTEPAIAFRIFRKLLEEKYGKEEAKRRIYATTDKERGALKTLANEEGFESFIIPDDVGGRFSVLTAVGLLPIAVSGADIDEMMKGARDASKDFSTSELEDNPAYQYAVVRNVLYNKGKTIEMLINYEPGLQYFAEWWKQLFGESEGKDEKGIYPSSANFSTDLHSLGQYVQEGRRDMFETVLNVEKPRHELTIEEADNDLDGLNYLAGKTVDFVNKKAFQGTMLAHTDGNVPNLIVNVPEMNAYTFGYLVYFFEKACAMSGYLLGVNPFDQPGVEAYKVNMFALLGKPGFEEKKAELEKRLNQ

SEQ ID NO: 29843 - protein, 459 aa, Bacillus cereus
MIQKQHESKLEVGQTFPVTIKRLGINGEGVGYFKRQVVFIPGALPGEEVVAETTKIQRGFAEAKVKKVRKASPHRVKAPCPVYEECGGCQLQHLDYKEQLNQKRDIVVQAFEKYMKNSLEEKIRPTLGMENPWHYRNKSQLQVGRKDEKVITGLYKQNSHQLIDIAHCMIQHKATNEATKVVRRILEKLNVSIYNEKKQKGLVRTIVTRTAVQTGEVQVTLITTKEELPNKEQFIAEVQKQMPAVKSIMQNVNWRKTSVIFGDKTFKLAGKEVIQETLGDLSFELSARAFFQLNPEQTVVLYNEAKKAAALTGNEKIVDAYCGVGTIGLWLANDAAEVRGMDVIPEAIADARKNAKRHGFTNTKYEAGKAEQWLPKWVKEGWRPDVIVVDPPRTGCDDKLLETILKVKPKQVVYVSCNPSSLARDVQALMKSYEVEYVQPVDMFPHTAHVENVVKLVRK

SEQ ID NO: 29844 - protein, 312 aa, Campylobacter jejuni
MLDVAIIGGGPAGLSAGLYATRGGLKNVVMFEKGMPGGQITSSSEIENYPGVAQVMDGISFMAPWSEQCMRFGLKHEMVGVEQILKNSDGSFTIKLEGGKTELAKAVIVCTGSAPKKAGFKGEDEFFGKGVSTCATCDGFFYKNKEVAVLGGGDTALEEALYLANICSKIYLIHRRDEFRAAPSTVEKVKKNEKIELITSASVDEVYGDKMGVAGVKVKLKDGSIRDLNVPGIFTFVGLNVRNEILKQDDSKFLCNMEEGGQVSVDLKMQTSVAGLFAAGDLRKDAPKQVICAAGDGAVAALSAMAYIESLH

SEQ ID NO: 29845 - protein, 473 aa, Bacillus cereus
MMDQNQGLKRELKSRHIFMIALGGVIGTGLFLGSGYTIHEAGPGGAIVAYLVGGFVMYLTMLCLGELAVAMPDAGSYQTYATKHISPAAGYVVGWMSWLNWSATIGIELIAVSILMKRWFPDVPSWIWCVVFAALLFAINALSSRSFAEVEFWFASIKVITIIAFIILGGAAMFGFLDMKGNEPAPMFSSFTDYGGLFPNGLSAILITMIAVNFSFQGTELVGIAAGESENPEKTIPKAINNTVWRILVFFVLSIFILAGLFPWQQAGVIESPFVVVFDKIGIPYAADIINFVIITAVLSVANSGLYATSRMLWSMSNQGMISPIFGKLSKNGVPIYALIVSTIVGCLSLLSGIYAEDTVYLWLLSIAGFGAILVWASIALSNLLARRSYIKQGGDVKDLKFKTPLYPFVPLLALVLNVTVIVGMAFIPEQRMALYCGIPFMIVCLLFYRATRNKGSNLEHIEKTKTTEIESL

SEQ ID NO: 29846 - protein, 104 aa, Campylobacter jejuni
MGKYIELTSDNFAQAKEGVALVDFWAPWCGPCRMLAPVIDELSNDFDGKAKICKVNTDEQGDLAAEFGVRSIPTLIFFKNGEVVDQLVGAQSKQAISDKLNSLL

SEQ ID NO: 29847 - protein, 589 aa, Oryza sativa
MGRRPARCYRQIKNKPYPKSRYCRGVPDPKIRIYDVGMKKKGVDEFSHCVHLVSWEKENVTSEALEAARIACNKYMTKSAGKDAFHLRVRVHPFHVLRINKMLSCAGADRLQTGMRGAFGKPQGTCARVDIGQVLLSVRCKPNNAVHASEALRRAKFKFLVAKRSLRVESGKYQTGGFTKFSRDEYVRLKSEGRIMPDGVNAKSFSPMGHVEEASGSDDDGVELLSVSWNQDNSCFIAATTNGFRVFSCKPFHETMRRMFGPNGGIGIAEMLFRTSIFGLAGAESNTEFPPTMLQLWDDYNERRIHKYNFTSEIRAVRLSKDYFVVVLEKTINVYRFKDLRLFYQARTVSNPNGLCCLSHHANASVFACPGTSKGQVLIEHFGLKETRFIAAHDSPLSCMTMALDGTLLATASVRGTLIRIFNTRDGTCVQEVRRGLDRAEIYSIALSPNVQWLAVSSDKGTVHVFSLRVKDAEEDAKKGESATAGAQVNDNCNYGSTVPVTQTKIGSNTSSSLSFMKGILPKYFSSEWSFAQFRLPEITRYIMAFGDQDTVMMIGLDGSFYRYSFDPVNGGEMMLKEYHLFLKASKSL

SEQ ID NO: 29848 - protein, 671 aa, Vigna aconitifolia
MESAVDPSRGFMKDVKRVIIKVGTAVVTREEGRLAVGRLGALCEQIKQLNSLGYDIILVSSGPVGIGRQRLRFRKLINSSFADLQKPQLELDGKACAAVGQNSLMALYDTLFTQLDVTSAQLLVTDNDFRDKDFRKQLTETVKSLLALKVIPVFNENDAVSTRKAPYEDSSGIFWDNDSLSALLALELKADLLVLLSDVEGLYSGPPSDPHSKLIYTYNKEKHQNEITFGDKSRVGRGGMTAKVKAAVHAAEAGIPVVITSGFAPENIINVLQGQRIGTLFHKDAHEWAQVKEVDAREMAVAAGNVREGSRRYLQRKGNKILLKIADALEANEKIIRIENEADVTAAQEAGYEKSLVARLALKPGKIASLANNMRIIANMEDPIGRVLKRTELSDGLILEKTSSPLGVLLIVFESRPDALVQIASLAIRSGNGLLLKGGKEAKRSNAILHKVIIEAIPDNVGGKLIGLVTSREEIPELLKLDDVIDLVIPRGSNKLVSQIKSSTKIPVLGHADGICHVYVDKSANVEMAKRIVLDAKVDYPAACNAMETLLIHKDLIEKGWLKEIILDLRTEGVILYGGPVASSLLNIPQAHSFHHEYSSLACTAEIVDDVYAAIDHINLYGSAHTDSIVAEDNEVANVFLRQVDSAAVFHNASTRFSDGARFETRRRGWN

SEQ ID NO: 29849 - protein, 748 aa, Mycobacterium avium
MFEATATIDNGSFGTRTIRFETGRLAQQAAGAVVAYLDDENMLLSATTASKSPKEHFDFFPLTVDVEERMYAAGRIPGSFFRREGRPSTDAILTCRLIDRPLRPSFVDGLRNEIQVVVTILSLDPNDLYDVLAINAASASTQLGGLPFSGPIGGVRVALIDGTWVAFPTVEQLERAVFDMVVAGRKVDGADGPDVAIMMVEAEATSNVIELIDGGAQAPTETVVAQGLEAAKPFIEVLCTAQQELADKAARPTSDYPTFPDYGDDVYYSVASVATDELSKALTIGGKAERDARTDELKAEVLARLAETYEGREKEVSAAFRSLTKKLVRQRILTDHFRIDGRGITDIRALSAEVAVVPRAHGSALFQRGETQILGVTTLDMVKMAQQIDSLGPETTKRYMHHYNFPPFSTGETGRVGSPKRREIGHGALAERALVPVLPSLEDFPYAIRQVSEALGSNGSTSMGSVCASTLALLNAGVPLKAPVAGIAMGLVSDDIEVEAGDGTKSLERRFVTLTDILGAEDAFGDMDFKVAGTKDFVTALQLDTKLDGIPSQVLAGALSQAKDARLTILEVMAEAIDEPDEMSPYAPRVTTIRVPVDKIGEVIGPKGKIINAITEETGAQISIEDDGTVFVGATDGPSAQAAIDRINAIANPQLPTVGERFLGTVVKTTDFGAFVSLLPGRDGLVHISKLGKGKRIAKVEDVVNVGDKLRVEIADIDKRGKISLVLVEEDNSAPADAPAAAPADATS

SEQ ID NO: 29850 - protein, 172 aa, Cydonia oblonga
MARFPEPLVVGRVIGDVLDSFTPTTHMSVTYNTKLVCNGLELFPSVVTAKPRVEIQGGELRSFFTLVMTDPDCPGPSDPYLREHLHWIVTDIPGTTDAAFGREVLSYEMPRPNIGIHRFVFVLFKQKRRQSINPPSSRDCFSTRSFAAENDLGLPVAAVYFNAQRENAARRR

SEQ ID NO: 29851 - protein, 179 aa, Bacillus halodurans
MSESKWALATFAGGCFWCMVSPFEEEPGIHQVVSGYTGGHTENPTYKEVCSETTGHYEAVQISFDPEVFPYEKLLEIYWTQIDPTDPGGQFHDRGDSYRTAIFYHDEQQKQAADASKQKLEESGKFNAPIVTRILPAKPFYPAEEYHQKYHKKNPFHYKMYRHGSGREAFIKQHWGESR

SEQ ID NO: 29852 - protein, 172 aa, Chaenomeles sinensis
MARVPEPLVVGRVIGDVLDSFTPTTHMSVTYNTKLVCNGLELFPSVVTAKPRVEIQGGELRSFFTLVMTDPDCPGPSDPYLREHLHWIVTDIPGTTDAAFGREVLSYEMPRPNIGIHRFVFVLFKQKRRQSINPPSSRDCFSTRSFAAENDLGLPVAALYFNAQRENAARRR

SEQ ID NO: 29853 - protein, 523 aa, Aspergillus nidulans
MLVDLTIDSDPEEQPRIPNPLIKSLGRQTLAHRTLSPSPHTKNSTIPFKRKSDADSAESGSESSYASAVAYPQKAKTRTTNVSSRNPVGHDSLSGPFKRVGAGPGTGAARQARQIPASAPSLASSSGTDSAAGHYAPSPAPETLRVVIPSPSVQLKKEIDSAERLPDAEVKTPEITGMSEKYYPTDALERRAMRGAYPAARKTNRAGVPLVIGTPGPFLTEKNRRPVIDLLCKNLQKKLASIKGPAVTVAKADEKRLAKATTGFEFINEYKLREGVAPISKEFQSGCSCETICLPDRCQCLAQEEDSEERIIAYKRARDNPRFMVLRPEFMKRTSMIFECNSLCGCEEKCWNRVVQLGRTIRLEIFHTGARGFGLRSLDTIRAGQFIDLYLGEVITTSKADQREKIANTRNAPSYLFSLDFLVDDESSYVVDGANYGAATRFINHSCNPNCRMFPVSRTHGDDYLYDLAFFALREIKPGTELTFDYNPGMERVDKLDPNAVPCLCGEPNCRGQLWATERKKAR

SEQ ID NO: 29854 - protein, 172 aa, Eriobotrya japonica
MARIPEPLVVGRVIGDVLDSFTPTTHMSVTYNAKLVCNGLELFPSVVTAKPRVEIQGGELRSFFTLVMIDPDCPGPSDPYLREHLHWIVTDIPGTADAAFGREALSYEMPRPNIGIHRFVFVLFKQKRRQSINPPSSRDCFSTRSFAAENDLGLPVAAVYFNAQRETAARRR

SEQ ID NO: 29855 - protein, 550 aa, Arabidopsis thaliana
MNHVPSDQSFYIESEDEDDRKDYVEEDGGSHSDSSDDVYDENQAHIKPSSYTTAWPQSYRQSIDLYSSVPSPGIGFLGNNSMTRFGSSFLSSGLIRRHTPESLPTVTKPLLEEQADEQALPKHRLSSQGLLSPIPSRRGSMRKDEKSSMVSHEIPMSRNSSYGQAVLNGLNVLCGVGILSTPYAAKEGGWLGLMILFVYGLLSFYTGILLRYCLDSESDLETYPDIGQAAFGTTGRIFVSIVLYLELYACCVEYIILEIDNLSSLYPNAALSIGGFQLDARHLFALLTTLAVLPTVWLRDLSVLSYISAGGVIASVLVVLCLFWIGLVDEVGIHSKGTTLNLSTLPVAIGLYGYCYSGHAVFPNIYTSMAKPSQYPAVLLTCFGICTLMYAGVAVMGYTMFGESTQSQFTLNLPQDLIATKIAVWTTVVNPFTKYALTISPVAMSLEELIPSRHIRSHWYAIGIRTLLVFSTLLVGLAIPFFGLVMSLIGSLLTMLVTLILPPACFLSIVRRKVTPTQMMLCVLIIIVGAISSVIGSYSALSKIVEKLTN

SEQ ID NO: 29856 - protein, 200 aa, Triticum aestivum
  misc_feature (189)..(189): Xaa can be any naturally occurring amino acid
MATLAKHLILCSMTSTLCSGSPSPSNRRPPSSADGVDKRAHLTQSSTRRLAVAASTFLVATAALSARRPAAPPPSMAAEAAAVRAPVPPGTVARWGTRSYVRERFFEPRLTTEEVAVRIRQTVEGMRTLRTMVETMSWKYVQYYVRLKSKYLDLELTTAMGGVPEARRPEYVLGANELVENMTEIAWRXERFVVTTKVYE

SEQ ID NO: 29857 - protein, 210 aa, Pinus pinaster
  misc_feature (83)..(83): Xaa can be any naturally occurring amino acid
  misc_feature (174)..(174): Xaa can be any naturally occurring amino acid
TSTLDSLVSQIHAACRDWGFFQVINHGVSPHFLQTILSEAANFFSLPMQEKCKVRRDFENPLGYYDTELTKNVRDWKEVFDFXMPSEFRLPASFEGESAEILTATNQWPENPPGLREACEKYAEAVEKLSFRLLELISLSLGLPARYFHSKFEDPTSRLRLNHYSPCPAPELAXGVGRHKDGGALTVLAQDEVGGLQVRRKDGEWIGVKP

SEQ ID NO: 29858 - protein, 571 aa, Aspergillus oryzae
MSETIHLTEYLFRRLREAGLQAVHGVPGDYNLLMMDYIVPAGLEWVGNCNELNAGYAADGYARVKGIGALVTTFGVGELSAINAIAGSYAEMAPVIHIVGTPKRAMQTRGAKLHHSVCSGKPSDFTMFAEMYSKITVAQENLWDASTAPAQIDRLIRECIIQSRPVYLQVPADMVTEPVPAAALSRPLDLTPPSNDPESEQEVCDIIVERISNGKQPFILIDAGTSRYGLVSEADELVRITGFPTATTPFGKGIPDETLPNFHGIYASVGEGAYLPYVESSDLIINIGPVHSNVNTSCFTTIPNPRVSIVFDQTSITIDGEVYNVFPKGVLKRVLDHLRDAMLSFWPYPNLPDPRSTLKHISRATSAGALTQDIFFKRMSYFFRPGDIILTETGTASNGGRDFVFPQNVSLINSGVWLSIGYMLGAAQGVALAQRNMGSQGRTILFIGDGSFQVTAQELSTIIRKKLSAIIFVINNDGYTIERLIHGMDADYNDIAMWRYLDSPSYFGAPSDDSYPVFTARVSTWGELDGVLSRESFQRGPGLRMVELMMGVSDCMETLRHFLKMYAARKE

SEQ ID NO: 29859 - protein, 112 aa, Methanosarcina acetivorans
MCKVEAIIKPLKLHQVKDALEESGFPSLTVTDVKGRGQQKGIVQQWRGKKYCVDLLPKTKVEVVVPEEEVEKIIQVIQSTAYTGEIGDGKIFVIPIETVVRIRTGERNGDAL

SEQ ID NO: 29860 - protein, 158 aa, Glycine max
  misc_feature (46)..(46): Xaa can be any naturally occurring amino acid
  misc_feature (92)..(92): Xaa can be any naturally occurring amino acid
  misc_feature (108)..(108): Xaa can be any naturally occurring amino acid
FLILISKQRLPHDHFPTVTTVNRAGAGLDAPLTGLKSMAGFPTRKXTNNDITSLASNGGRLQCMRGWPPGGKNNLETLSYLPDLDDAQLPKXVEYLLRKGWIPCLEFXLEHGFESREHTRKPGYYHGRYWTMWKLPMFGCTDAPEVLKELQEANTAYP

SEQ ID NO: 29861 - protein, 165 aa, Oryza sativa
NPLRRRRLRREISQIQSSAASSSPLLSSSMARTKQTARKSTGGKAPRKQLATKAARKSAPATGGVKKPHRFRPGTVALREIRKYQKSTELLIRKLPFQRLVREIAQDFKTDLRFQSSAVAALQEAAEAYLVGLFEDTNLCAIHAKRVTIMPKDIQLARRIRGERA

SEQ ID NO: 29862 - protein, 477 aa, Unknown
  Shewanella sp. ANA-3
MNYFTKTTALSGLKLSLLTAALLSNWGAMAQNAPNELPTSAAPKSHLPKDEVQNSDAQKFPLQHQSWGATIEQAEREDVLEKNPRNVILWAGSSYAKEYHSPRGHQFAVADVSHTLRTGVAPKAGEKGLSASCWTCKSPDAPRLIGELGFEGYAAKNFTDLGAEMKSVVYCSDCHESGSAKLTLPRPHAKDAMAKIHLPFEQQNATMQSAQVCGQCHVTYYFRPEKSNVVNIPWIFGNTADEIEKYYDTRRFYEWVHPLSKAPMLKARHPEFEHWSRSKHAEVGVTCVTCHMPSAQDKKGNEFTNHKVDKALPNFETSCKGCHSSKDKLETKLTDLKTEIDNKAHAVEDLLVKAHYEAKAAWVAGATWEQMNDPIMDIRHSQWRWDFAMSSHGLYAHNPKEGRQLLDTALEQAKSARTSLAEVLKQLNSEVYYPDISTKAKAQEAIGLNEAELIKEKQQFIKEEIDKNWDPVAHRGY

SEQ ID NO: 29863 - protein, 336 aa, Solanum lycopersicum
MAFLSSLLASLLLVGLLIQITGAQPIGVCYGKIANNLPSDQDVIKLYNSNNIKKMRIYFPETNVFNALKGSNIEIILDVPNQDLEALANPSKRQGWVQDNIRNHFPDVKFKYIAVGNEVDPGRDSGKYARFVGPAMENIYNALSSAGLQNQIKVSTATYLGLLTNTYPPRDSIFRDEYKSFINPIIGFLSRHNLPLLANIYPYFGHADDNVPLPYALFKQQGLNDAGYQNLFDALVDSMYFATEKLGGQNIEIIVSESGWPSEGHPSATLENAMTYYTNLINHVKGGAGTPKKPGRTIETYLFAMFDENRKDGKPSEQHFGLFKPDQRPKYQLKFD

SEQ ID NO: 29864 - protein, 612 aa, Unknown
  Synechococcus sp. WH 8012
  misc_feature (145)..(145): Xaa can be any naturally occurring amino acid
VCIKGATVGETLAPGRLRQPLFRPTLEDDFAPISWDDALNKITGQIQASVAQRGNADGIAMYGSGQFHTEDYYLAQKLLKGALGTNNFDANSRLCMSSAVAGYTRSLGSDGPPCSYEDLDHCTVAFLIGTNTAECHPVLFQRLLXRKRKNPGSVKIVVVDPRRTDTAKAADIHLPIAPGSDLALLHGIAHLVLRENGQDPAFIDDHTENYDAFFDVAARWTPRRVALFCNIPEKRLREVAALFHRREKVLSLWSMGVNQRREGTAVVQGLINLHLLTGQIGKQGAGPFSLTGQPNAMGGREAGGLAHLLPGYRLVANAEHRAEVEQAWQLPAGRINAKPGLAAWQQIEAMEQEALDLWWVAATNPLVSLPDLDRVKSAMQKCPLVVVSEAYADSETSHYAHLLLPAAQWSEKAGAMTNSERRVTYCPAYRRRFGESRPDWEVFAEVGRRLGYSEQFNFESAAEVYTEFTALTQGRLCDVSGLSHELLEGEGPQQWPYPSGSTPTTEAKRLYENHQFATPNKRARFSTDQPLGLAEPPCDTYPLVLTVGRYLGQWHTMTRTGKVERLMKQHPEPLLEIHPGDAQELKLRNGELAAISSRRGHLTATVKVTDRI

SEQ ID NO: 29865 - protein, 360 aa, Solanum lycopersicum
MATSQIAIIVLLGLLVATNIHITEAQIGVCYGMMGNNLPSHSEVIQLYKSRNIRRLRLYDPNHGALNALRGSNIEVILGLPNVDVKHISSGMEHARWWVQKNVRDFWPHVKIKYIAVGNEISPVTGTSNLAPFQVPALVNIYKAIGEAGLGNDIKVSTSVDMTLIGNSYPPSQGSFRNDVRWFTDPIVGFLRDTRAPLLVNIYPYFSYSGNPGQISLPYALFTAPNVVVQDGSRQYRNLFDAMLDSVYAAMDRTGGGSVGIVVSESGWPSAGAFGATHENAQTYLRNLIQHAKEGSPRKPGPIETYIFAMFDENNKNPELEKHFGMFSPNKQPKYNLNFGVSERVWDITNSTASSLTSEI

SEQ ID NO: 29866 - protein, 1098 aa, Xanthobacter autotrophicus
MLEPVTAGDDPLWYKDAIIYQLHVKSFYDANDDGIGDFRGLISKLDYIADLGATAVWLLPFYPSPRRDDGYDISLYEGVSPDYGTMDEARRFIAEAHARGLRVITELVINHTSDQHPWFQAARRAPKGSPERNFYVWADDDKGYPGVPIVFCDVEKSNWTYDEVAGQFFWHRFYSHQPDLNFDNPEVLERVLSIMRFWLDLGVDGLRLDAVPYLVEREGTDCGNLPETHAILKQIRAHLDAHYTGRMLLAEANLWPEDTQQYFGADADECHMAFHFPIMPRMYMAIAKEDRFPITDILRQTPEIPPTCQWAIFLRNHDELTLETVTDSERDYLWSVYAADRRARINLGIRRRLAPLLERDRRRMELMNSLLLTLPGTPVIYYGDEIGMGDNIHLGDRDGVRTPMQWSPDRNGGFSRADPERLVLPVIQDPLYGYGAVNVEAQLRDSHSLLNWTRRFLAVRRQHAAFGRGTFRQLFPRNRRILAYLRELEGEAVLCVANLAHTLQAVELDLADFERRVPVDLVSGTTLAALGRAPLILTLPPYGFYVFNLSQTAAEPSWRDPAPEALPEFATLVVREGLMGALSEQHRAVIENEALPGYLARRRWFQGRAQDIGATRLGWAMRLPGTERDVVLAEVEADIAGATERYLMPLCIAWEDQHPPAIAEQLALTRVRQGRRVGFLTDAAVLDGLAAGVVRSLREEAPVELPDGGAIVFSRTSHLDGVTVERGAPAQFIDADEPAANLVVTDRVAVKLFRHMKFGHTAEEEMARHLSTLGLPQVPPLLGAVTRTDRAGARAPLALVYGRMQHQGNAADWTMTQLQRALDTAASTVDGARQRFEDEIAGMMALVRNMGRRLGELHAALSAPTDATGFTPQDADAELRALWLSRAEAAYSAALDALDRLPAPDGARQSRRAELEGMRAALNERLGVLYSGTPLPLIRIHGRCDLHHMLVAGGDALIVGALGGLEGVQEGERAPQSPWRDVAELLAALERAAARIGGGETGAARDAPQLRAELIAAFLARAERAVLGAYLERAPTIATASRPLAEAFNLEALARAVVAERERPRCVHALASALHRQTARLLKTADAEEAAALARGPS

SEQ ID NO: 29867 - protein, 112 aa, Azospirillum brasilense
MKKIEAIIKPFKLDEVKEALHEVGIKGITVTEAKGFGRQKGHTELYRGAEYVVDFLPKVKIEVVMEDSLVERAIEAIQQAAHTGRIGDGKIFVTPVERIVRIRTGEKGGDAI

SEQ ID NO: 29868 - protein, 299 aa, Triticum aestivum
  misc_feature (204)..(204): Xaa can be any naturally occurring amino acid
  misc_feature (282)..(282): Xaa can be any naturally occurring amino acid
ARPSSSSAPPPAPRRPRATSFSSNDEAFTWAKKDNRRLLHVVYRVGDIDRTIKFYTECLGMKLLRKRDIPEEKYTNAFLGYGPEETNFAIELTYNYGVDSYDIGAGFGHFGIATDDVAKTVELIRAKGGKVTREPGPVKGGKTVIAFIEDPDGYKFEILERPGTPEPLCQVMLRVGDLDRAISFYEKACGMKLLRKRDNPEYKXTIAMMGYGPEDQNAVLELTYNYGVTEYDKGNAYAQIAIGTDDVYKTAEVVKLSGGKVVREAGPLPGLGTKITAILDPXGWKSVFVDNIDFAKELE

SEQ ID NO: 29869 - protein, 314 aa, Unknown
  Candidatus Pelagibacter ubique HTCC1002
MSENPIKHTKVLIIGSGPAGYTAAVYAARAMLNPILVYGVQPGGQLTTTTDVENYPGFSDVIQGPWLMDQMRDQAKAVGTDLIEDHISSVNLKSTPFEAIGDSGQKYKADSIIISTGAQARWLNLESEQAYRGFGVSACATCDGFFFKEKVVAVVGGGNAAVEEAMFLTKFASKVKLIHRRDTLRAEKLLQKKLMENKKIEIIWDSAVEEVIGDSEPKNVKAIKIKNLKTNKIEEMKIDGLFIAIGHDPATALFKEQLEMDKEGYLLTKPDSTETNIPGVYAAGDVKDKTFRQAVTAAGMGCMAALEAEKFLSH

SEQ ID NO: 29870 - protein, 714 aa, Brucella melitensis
MFNTHKVEIEWGGRPLTLETGKIARQADGAVLATYGETAVLATVVSAKEPKPGQDFFPLTVNYQEKTYAAGKIPGGYFKREGRPSENETLVSRLIDRPIRPLFVDGYKNDTQVVITVLQHDLENNPDILSMVAASAALTISGVPFMGPISGARVGYIDGEYVLNPNIDEMPESKLDLVVAGTSEAVLMVESEAQELPEDVMLGAVMFGHKSFQPVIDAIIKLAEVAAKEPRDFQPEDLSELEAKVLAVVENDLREAYKITEKQARYAAVDAAKAKAEEHFFPEGVEETEMSAEQFATIFKHLQAKIVRWNILDTGNRIDGRDLSTVRPIVSEVGILPRTHGSALFTRGETQAIVVATLGTGEDEQMIDALTGTYKESFMLHYNFPPYSVGETGRMGSPGRREIGHGKLAWRAIHPMLPAAEQFPYTIRAVSEITESNGSSSMATVCGTSLALMDAGVPIVRPVAGIAMGLIKEGERFAVLSDILGDEDHLGDMDFKVAGTEFGITSLQMDIKIDGITEEIMKVALEQAKGGRVHILGEMAKAISSSRAELGEFAPRIEVMNIPTDKIRDVIGSGGKVIREIVEKTGAKINIEDDGTVKIASSNGKEIEAAKKWIHSIVAEPEVGEIYEGTVVKTADFGAFVNFFGPRDGLVHISQLAADRVAKTTDVVKEGQKVWVKLMGFDERGKVRLSMKVVDQETGKEIVAEKKKEEVDAE

SEQ ID NO: 29871 - protein, 530 aa, Aspergillus nidulans
MQTWRRTFVTSLPKLNHRPPAATSPTLLRCNQVLQSSRQETCSLEDQEIRLHGFVRSVRKQKRFAFAEISDGTAVEGIQAILKPAQAAELSTGTAIEISGIWKACPPGKEQSHELQATSVNITYPIQKKYHSPEFLRHIPHLRFRTPLNALLARFRSECLYQLGNVFRGAPNGGFVQVHPPVITSSDCEGAGETFAVIPRETLIKGLPKEEHDHFFRAPKYLNVSSQLHLEAYAAELGNVWTLSPMFRAEKSDTPRHLSEFYMLEAEVNFLSDLDALTDTVEYLLRDLTRRLYDTPAAQEILSIKRDKGPETQDSGEQIDLHQRWADLMSGSKWRCITYSDAIAALQEAVSQGKAAFEFSPTWTGGLQLEHEQYIVNTLNNGQPIFVTDYPKVIKPFYMAPSHTQSNPKAEGETVACFDLLLPEVSEVAGGSLREHRLPELIQNMREHNLIKTSPSNSEEEANQGEAPYPHLLPGEDLSHLQWYADLRRWGSAPHGGFGLGFDRFLGYLTGVQSIRDTVAFPRYFGRADC

SEQ ID NO: 29872 - protein, 481 aa, Chlamydophila caviae
MTEQADIGLIGLAVMGKNLVLNMIDHGFSISVYNRSPEKTREFLQEHSQNTLLQGHENLEDFVRSLKRPRKVMLMIKAGAPVDQSIESLLPYLEPGDIIIDGGNSYYKDSERRCRDLKEKGILFVGMGISGGEEGARKGPSIMPGGNSEAWPAIAPIFQGISAKVHGNPCCCWVGSGGAGHYVKTVHNGIEYGDIQLICEAYGLLRTRLGISPEGISEIFAEWNSRELESYLMRISVEVLSLKGPDGSPVIDTILDVAGQKGTGRWTAIDAIDSGVPLSLIIESVLARFLSSWKTVREQAASELPGIPIVFEKPRDPHLFIEDVFQALYASKIISYAQGFMLLKQASEEHQWNLNFGELALLWRGGCIIQSAFLDAIHKGFENEPEAPSLILQTYFKSTLQNSESGWRRTVAYAVGSGYPVPCLAAALTFYDGYRTKDSSIALAQGLRDYFGAHSYERKDRPRGEFYHTDWIGTKTTTAVK

SEQ ID NO: 29873 - protein, 838 aa, Glycine max
MSCKDGSRNGIGMDNGKYVRYTPEQVEALERLYHDCPKPSSIRRQQLIRECPILSNIEPKQIKVWFQNRRCREKQRKESSRLQAVNRKLTAMNKLLMEENDRLQKQVSQLVYENGYFRQHTQITTQATKDTNCESVVTSGQQHNLITQHPPRDASPAGLLSIAEETLAEFLSKATGTAVEWVQMPGMKPGPDSIGIVAISHGCTGVAARACGLVGLEPTRVAEILKDQPLWFRDCRAVDVLNVLPTASGGTIELLYMQLYAPTTLAPARDFWLLRYTSVLEDGSLVICERSLKNTQNGPSMPPVQHFVRAEMLPSGYLIRPCEGGGSIIHIVDHMDLEPWSVPEVLRPLYESSTVLAQKTTMAALRHLRQISHEVSQSNVTGWGRRPAALRALSQRLSRGFNEALNGFTDEGWTTIGNDGVDDVTILVNSSPDKLMGLNLSFANGFPSVSNAVLCAKASMLLQNVPPAILLRFLREHRSEWADNNMDAYTAAAIKVGPCSLSGSRVGNYGGQVILPLAHTIEHEEFLEVIKLEGIAHSPEDTIMPREMFLLQLCSGMDENAVGTCAELISAPIDASFADDAPLLPSGFRIIPLESGKEASSPNRTLDLASALDVGPSGNRASNGCANSSCMRSVMTIAFEFAFESHMQEHVASMARQYVRSIISSVQRVALALSPSHLSSHAGLRSPLGTPEAQTLAHWICNSYRCYLGVELLKSNNEGNESLLKSLWHHSDAILCCTLKALPVFTFSNQAGLDMLETTLVALQDITLEKIFDDHGRKILFSEFPQIIQQGFACLQGGICLSSMGRPVSYERVVAWKVLNEEENAHCICFMFVNWSFV

SEQ ID NO: 29874 - protein, 538 aa, Lophopyrum elongatum
MGYQVVAAQLARLSGALGTPDHASVVSINLFVALLCACIVLGHLLEENRWLNESITALIIGLCTGVVILMTAKGKSSHVLVFSEDLFFIYLLPPIIFNAGFQVKKKQFFRNFMTITLFGAVGTMMSFFTISLAAIAIFSKMNIGTLDVSDFLAIGAIFSATDSVCTLQVLNQDETPFLYSLVFGEGVVNDATSVVLFNALQNFDPNQIDAIVILKFLGNFCYLFVSSTFLGVFTGLLSAYVIKKLYIGRHSTDREVALVMLMAYLSYMLAELLDLSGILTVFFCGIVMSHYTWHNVTESSRVTTKHAFATLSFIAETFLFLYVGMDALDIEKWKFASDSPGKSIGISSILLGLVLVGRGAFVFPLSFLSNLTKKTELEKISWRQQIVIWWAGLMRGAVSIALAYNKFTRSGHTQLHGNAIMITSTITVVLFSTMLFGILTKPLIRFLLPASSNGAASDPASPKSLHSPLLTSQLGSDLEAPLPIVRPSSLRMLITKPTHTIHYYWRKFDDALMRPMFGGRGFVPYSPGSPTDPNVLVE

SEQ ID NO: 29875 - protein, 449 aa, Francisella tularensis
MNAQKYIDSVIAQVEKRDGHEKEFIQAVKEVFSTLKPALEHNPKYIEENILARMVEPERGISFRVPWVDKDGNIQVNRGYRYQFNGAIGPFKGGIRFHPSVYSGIIKFLGFEQVFKNSLTTLPMGGGKGGADFDPKGKTDAEIMNFCQSFMMELQRHIGPDIDVPAGDIGVGGKEIGYMYGQYRRIRACFENGVLTGKSLESGGSLIRPEATGYGAVFFLDEMLKHDGETLQGKTVVTSGYGNVAWGVCKKVAQLGGKVVTISGSKGFVHDPEGITTDEKIEFLLKIRNGEKTMQDYAKEFNASWHAGQKPWGIKADIAIPAATQNEIDFEDAQKLIDSGVKYVVEASNMPTTNEAIEFLMKKGIILAPGKAANAGGVAVSGLEMSQNSARLSWSAEEVESKLQQIMANIFHACKFASSKYNLGYNLVAGANLAGFEKVAEAMIQQGRY

SEQ ID NO: 29876 - protein, 528 aa, Pseudomonas putida
  misc_feature (26)..(26): Xaa can be any naturally occurring amino acid
MASVHGTTYELLRRQGIDTVFGNPGXNELPFLKDFPEDFRYILALQEACVVGIADGYAQASRKPAFINLHSAAGTGNAMGALSNAWNSHSPLIVTAGQQTRAMIGVEALLTNVDAANLPRPLVKWSYEPASAAEVPHAMSRAIHMASMAPQGPVYLSVPYDDWDKDADPQSHHLFDRHVSSSVRLNDQDLDILVKALNSASNPAIVLGPDVDAANANADCVMLAERLKAPVWVAPSAPRCPFPTRHPCFRGLMPAGIAAISQLLEGHDVVLVIGAPVFRYHQYDPGQYLKPGTRLISVTCDPLEAARAPMGDAIVADIGAMASALANLVEESSRQLPTAAPEPAKVDQDAGRLHPETVFDTLNDMAPENAIYLNESTSTTAQMWQRLNMRNPGSYYFCAAGGLGFALPAAIGVQLAEPERQVIAVIGDGSANYSISALWTAAQYNIPTIFVIMNNGTYGALRWFAGVLEAENVPGLDVPGIDFRALAKGYGVQALKADNLEQLKGSLQEALSAKGPVLIEVSTVSPVK

SEQ ID NO: 29877 - protein, 319 aa, Clostridium acetobutylicum
MKTIAVLTSGGDAPGMNAAIRAVVRTAIEKGINVKGIQRGYSGLINGEIFDMNRHSVSDIIQRGGTILRTARCPEFLKEEVRQKAANVLRVFGIDGLVVIGGNGSFMGAQKLSKLGVKTVGLPGTIDNDLPYTDYTIGFDTTLNTVLDAINKLRDTSTSHERVSIIEVMGRDCGDIALFSGIAGGAESVIIPEIGYDFNELCKNILEGKLRGKMHNLIILAEGVGGAAELAKKVEEVTGIETRSTILGHIQRGGSPSAFDRMLASRMGVKAVEVLMEGKTSRVIGIKEGKIMDQDIDEALAVPRSFNKELYDIANMLSK

SEQ ID NO: 29878 - protein, 205 aa, Cryptococcus neoformans
MTISSRSSLSVTLASVNLLSRFTRNEFNLESKSTIGVEFATRSINVDGKTVKAQIWDTAGQERYRAITSAYYRGAVGALLVYDIAKHQTYENVTRWLKELRDHADANIVIMLVGNKSDLKHLRAVSTDEAKQFATENGLSFIETSALDASNVESAFQNILTDIYRIVSSKSLESSGDVIKPSGGETILVAPTADDGGAKSGSKCC

SEQ ID NO: 29879 - protein, 241 aa, Zea mays
RHQHQQLRHLVRAHQDRRGWRVRASEPRQQLLLPPADLRGQGGLPERHDSDHQEGGAPQDFEEAVLSRKISNIEYHLKGAKIFDKKAKTLITREAVNGTSTDSKTTITLKYSVIKGKLWDSSKSMKLGVTTTIEAGVPVVLPATIEVQSEFNSTYSWGESIIEKEEYSNAYEVVVPAYSVVTVSVLATQGICQVPFSYTQEDVLTTGERKVFKFDDGIFRGVNSFGFKSEVTERKLSKDDD

SEQ ID NO: 29880 - protein, 441 aa, Arabidopsis thaliana
DAIGITPLYIGWGLDGSVWFASEMKALSDDCEQFMCFPPGHIYSSKQGGLRRWYNPPWFSEVVPSTPYDPLVVRNTFEKAVIKRLMTDVPFGVLLSGGLDSSLVASVALRHLEKSEAACQWGSKLHTFCIGLKGSPDLKAGREVADYLGTRHHELHFTVQDGIDAIEEVIYHVETYDVTTIRASTPMFLMSRKIKSLGVKMVLSGEGSDEIFGGYLYFHKAPNKKEFHEETCRKIKALHQYDCLRANKSTSAWGVEARVPFLDKEFINVAMSIDPEWKMIRPDLGRIEKWVLRNAFDDEKNPYLPKHILYRQKEQFSDGVGYSWIDGLKDHANKHVSETMLMNASFVFPDNTPLTKEAYYYRTIFEKFFPKSAARATVPGGPSVACSTAKAVEWDAAWSQNLDPSGRAALGVHVSAYGEDKTEDSRPEKLQKLAEKTPAIV

SEQ ID NO: 29881 - protein, 465 aa, Pseudomonas aeruginosa
MDFLPLFHSLQGRLALVVGGGEVALRKARLLADAGARLRVVAPQIHIELRHLVEQGGGELLERDYQDGDQPGCALIIAATDDEPLNAEVSRAANARGIPVNVVDAPALCSVIFPAIVDRSPLVVAVSSGGDAPVLARLIRAKLETWIPSTYGQLAGLASRFRHRVKELLPDLQQRRVFWENLFQGEIAERVLAGRPAEAERLLEERLAGGLAHIATGEVYLVGAGPGDPDLLTFRALRLMQQADVVLYDRLVAPSILELCRRDAERLYVGKRRAEHAVPQDRINRLLVELASQGKRVLRLKGGDPFIFGRGGEEIDELAARGIPFQVVPGITAASGCAAYAGIPLTHRDHAQSVRFVTGHLKDGTTDLPWQDLVAPGQTLVFYMGLVGLPVICEQLVAHGRSAQTPAALIQQGTTAQQRVFTGTLENLPQLVAEHEVHAPTLVIVGEVVQLRDKLAWFEGAREDA

SEQ ID NO: 29882 - protein, 406 aa, Clostridium perfringens
MNKEIKLRNDIYSVGVIDNRPVPFHRLILEKGTTYNSYLLKTRKPTVIDTVDLIYTKDFLNNLKEIIDLKDISYIVINHTEPDHSGALGGLARQAINAKIVCSEKAVYHLKELYKLHDRDFIVVNDGDTLDIGGKTLLFKMTPYLHTEETMITYDVEDKILFPCDIFSTHLTAKEHFSSKSNEDITEDFLTYYKLIMEPHRKYIRPLIDILKDLDIEVIAPSHGYILDENIQSYIDIYDKYSKETKKGKKATIVYTTMRNATKKIAEKFKSELENEDIEVYIFNADKSTKEDILASIKESDSILFGTSTKYGDLIGSIEDILKELPKLDLSNKLLGAFGSFGWSGEPIEIIQDYLNSTNGNVLNTSSIIKSTGMIDVHFPVRIRFSLNEESEKEVVRAADYISSII

SEQ ID NO: 29883 - protein, 486 aa, Candida glabrata
MVHLGPKKPPARKGSMVDMPKDLLDEIKKFEDMFSVDAATLQKVTKHFISELSKGLSKEGGNIPMIPAWVMENPTGKEKGDFLAIDLGGTNLRVVLVKLGGDRTFDTTQSKYKLPGPMRTTKDPEEIWSFIADSLETFIKEQFPEGCNETLPLGFTFSFPASQDKINQGVLQRWTKGFDIPNIEGHDVIPMLQKQIEKRNLPIDIVALINDTTGTLVASLYTDGETKMGVIFGTGVNGAYYDVVSDIPKLEGKLADDIPSSSLMAINCEYGSFDNEHVVLPRNKYDIAIDEESPRPGQQTFEKMSSGYYLGELLRLALLDLYNQGLIFKGQDVQKLKEAYIMDTSYPSRIEDDPFENLEDTDELFQADLGIQTTVQERKLIRRLCELIGTRSARLSVCGIAAICQKRGYETAHIAADGSVFNKYPGFQQRAAEGLRDIYGWKEDKPQNYPIVIVAAEDGSGAGAAIIAALAQKRIAEGKSLGVIGA

SEQ ID NO: 29884 - protein, 170 aa, Prochlorococcus marinus
MLSSIDKFLKLMVVDVQNTTVVSANGEAKKLGQYSGNVILIVNVASYCGNTAQYKDLQKLHDKYSKKGLRILAFPCNDFGNQEPDSLTEIKNFCSTKYGVEFEIMEKVHAKGNTSEPYTTLNNVEPKGDVEWNFEKFLIGKDSNVIARFKPGIQPFDENLIAAIEVAIDS

SEQ ID NO: 29885 - protein, 328 aa, Unknown
  Nicotiana langsdorffii x Nicotiana sanderae
LQHSFTAHPKVDPVTGEMFTFGYSQTPPYATYRVISKDGVMQDPVPITIPASVMMHDFAITENYSIMMDLPLYFKPKEMVKNKKLAYSFDPTKKARFGILPRYAKNESLIKWFELPNCFIFHNANAWEEGDDVVLITCRLQNPDLDAINGTEKEQQRDGFTNELYEMRFNIKTGLASQKKLSESAVDFPRINENYTGRKQRYVYGTILNNVAKITGVVKFDLHAEPETGKTKLEVGGNVLGIFDLGPGRFGSEAIFVPRQPGTECEEDDGYLILFVHDENTGKSSVNVIDAKTMSAEPVAVVELPKRVPYGFHAFFVTEEQIQEQAKL

SEQ ID NO: 29886 - protein, 556 aa, Clostridium perfringens
MSKIYDLVIIGGGPAGLSAGIYAGRAKMNTLIIEKGELGGQVNKTFDISNYPGSRNTNGPKLMSEMRAQAEDFKVKFMNGEVLEVSLEGDIKEIKTDKGLVQGRSVIIATGAAPRQLGFKGEEEFTGRGVAYCATCDGQFFEGLEVFVIGAGFAAAEEAIFLTRFASKVTVIAREPEFTCAKSIADKVLSNPKIEVKFNTEIIEAKGKDMVNYAKFKNNVTGEIFEYRAKKEDGAFGIFVFVGYAPKSELFKDILELDKQGYIITNEDMETNINGVYVAGDLRPKSLRQIVTAVSDGAIAATTAERYVKELKEKLGIEDEYLEEEENIQEEKNSDENNDLGNISRKSSLLNDVLRAQLKGILSKIENEVTLVSIVDRSNTKSIELRDLVLDISDLGEKINAKIFNRGENKEVEEKINADKYPIVALLDENENYSGIKFHGVPGGHELNSFILAIYNLGGPGQGIDEGVLDEIKKLDKKTNIKVCVSLSCHLCPDVVVSAQRIAKENKNIEAEMIDLANFKDIKDEFKIMSVPALIVNNKDVYFGSKKIEEILEIIK

SEQ ID NO: 29887 - protein, 458 aa, Escherichia coli
MAVMGRNLALNIESRGYTVSIFNRSREKTEEVIAENPGKKLVPYYTVKEFVESLETPRRILLMVKAGAGTDAAIDSLKPYLDKGDIIIDGGNTFFQDTIRRNRELSAEGFNFIGTGVSGGEEGALKGPSIMPGGQKEAYELVAPILTKIAAVAEDGEPCVTYIGADGAGHYVKMVHNGIEYGDMQLIAEAYSLLKGGLNLTNEELAQIFTEWNNGELSSYLIDITKDIFTKKDEDGNYLVDVILDEAANKGTGKWTSQSALDLGEPLSLITESVFARYISSLKDQRVAASKVLSGPQAQPAGDKAEFIEKVRRALYLGKIVSYAQGFSQLRAASEEYNWDLNYGEIAKIFRAGCIIRAQFLQKITDAYAENPQIANLLLAPYFKQIADDYQQALRDVVAYAVQNGIPVPTFAAAVAYYDSYRAAVLPANLIQAQRDYFGAHTYKRIDKEGVFHTEWLD

SEQ ID NO: 29888 - protein, 260 aa, Unknown
  Synechococcus sp. RS9916
MTSSSSAEPSTIAIVGAGPGAPDLLTRRAEDRLRAADVLIWTDSLVSPQIAALAPEGCERIRTSTLTLEDVLPLMIDRARQGLRVVRLHDGDPCLYGALSEQVCSLADAGIAVEVVPGLSAYQATASALSAELTIPGVVQTIVLSRAGGRTGVPEAEDLSNLARLKASLCLYLSARHVDEVQATLLEHYPADTPVAIGYRVSWPDQWLNVVPLNQMAAVSKERQLIRTTLYVVSPALANQGERSKLYSPSHDHLFRPQAS

SEQ ID NO: 29889 - protein, 142 aa, Triticum aestivum
DQWFPETARAMVLQGAEILFYPTAIGSEPQDMNLDSREHWKRVMQGHAGANLVPLVASNRIGKETVETEHGNSTIKFYGNSFIAGPTGEIVKLANDKDEEVLVAEFDLDEIKSTRHGWGIFRDRRPDLYKVLLTLDGKTSSS

SEQ ID NO: 29890 - protein, 300 aa, Clostridium perfringens
MVFNSLLSLIGNTPILKANNLFEGNNVFVKLEKFNPGGSIKDRAALGMIEEAEKNGLLKENGVIVEPTSGNTGIAIAMIGKIKGYKVIITMPETMSKERRDMIKAYGAEIILTEGSKGMKGAIEEAERLASTKGYFMPQQFLNEANAKKHYETTAEEIIRDIPDLDVFIAGVGTGGTITGVGRKLKEYNPNIKIVAVEPSDSAVLSGENSGPHKIQGIGAGFIPKIYDSSVVDEIIKVKNEDAYTMAKNFADKEGVLVGISSGAALKGAKDILENIAKDKKVLVIAPDGGEKYFSTGLYE

SEQ ID NO: 29891 - protein, 366 aa, Rhodospirillum rubrum
MAEIRRIGVLTSGGDCAGLNAVIRAVTHRARRAYGWKVFGILDGTMGLMDRPLRYRELDSEMFSGFDILRAGGTVLGTVNKGDPFAFPMADGSKTDRSLDFVDGFHSLELDALVVVGGDGSMRILKKLCDKGSIGMVGVPKTIDNDVHGTEYAVGFSTATNVVTEALDRLQATAASHHRVMILEVMGRDAGHIAVSAGIAGGADVILIPEIPYTLEGVAKRIREVQQEGRSHALIVVAEGVLTPEGERATVAYAGGQTRYGGISQYLSDRIAQDTGTETRVTILGHVQRGGIPSMRDRLLASAFGVHAVDLVAARKFGRMVAWQDRGVVDVPLEEVCIGPRSLDPNGTLVHAARGLGIYVGEIGAA

SEQ ID NO: 29892 - protein, 389 aa, Unknown
  Shewanella sp. ANA-3
MEKAIRNFLSQESAGGILLLVAVVLAMLMANSPLAGLYQGFLGTEVQVRVGALDLHKPLLLWINDGLMALFFLLIGLEVKRELLEGALSSVAQASLPTFAAIGGMLVPAGIYLLFNYGDPVTQVGWAIPAATDIAFALGIMALLGSRVPVALKVFLLALAIIDDLGVIVIIALFYSSDLSTISLIIASIAIVGLVALNRKGVTALAPYGVLGLVLWVAVLKSGVHATLAGVIIAFCIPLRAKDGSSPSEHLEHSLHPWSTFLILPVFAFANAGVALGNMSLDALISPVPVGIALGLMLGKPIGVMLFSYVAVKLKLAQLPDGIGWKQIAPVAAMCGIGFTMSMFIASLAFEQADPMFGDLARLGTLIGSILAALIGYFWLSKVLPKKGV

SEQ ID NO: 29893 - protein, 271 aa, Glycine max
  misc_feature (156)..(156): Xaa can be any naturally occurring amino acid
  misc_feature (167)..(167): Xaa can be any naturally occurring amino acid
  misc_feature (176)..(176): Xaa can be any naturally occurring amino acid
  misc_feature (184)..(184): Xaa can be any naturally occurring amino acid
  misc_feature (210)..(210): Xaa can be any naturally occurring amino acid
MEKGRTVVVSALQFACTDDISTNVATAERLVRAAHKQGANIILIQELFEGYYFCQAQREDFIQRAKPHKDHPTILRMQKLAKELGVVIPVSFFEEANNAHYNSIAIIDADGTDLGIYRKSHIPDGPGYEEKFYFNPGDTGFKVFQTKLAKIGVAIXCWDQWFPEASXRPMVLQGAXEIYFIPTXAIGSEPQDGSIDSREHWKPVMQGHAXGANLVPLVASNRIGKEIIETEPWKSEITFYGNSFIAGPTGEIISTADDKDEAVLIAQFDLD

SEQ ID NO: 29894 - protein, 958 aa, Photorhabdus luminescens
MTQTLSQLENQGEFIRRHIGSSAEQQKEMLATVGASSLNDLTQKIVPRDIALPEPPDVGGGATEQQALAELKAIASQNKRYQSYIGMGYAPAVLPPVILRNLLENPGWYTAYTPYQPEVSQGRLESLLNFQQVTIDLTGLDIASASLLDEATAAAEAMAMAKRISKLKNADRFFVADDIHPQTLDVVRTRAETFGFDVIVDKAEKVLELDGVFGVLLQQVGTTGEVHDYADLIAQLKQRKIIVSVAADLMALLLLTAPGKQGADMVFGSAQRFGVPMGYGGPHAAFFASRDEFKRSMPGRIIGVSRDAAGNTALRMAMQTREQHIRREKANSNICTAQVLLANIAAMYAVYHGSKGLKRIAGRIHRLTDILAVGLQKAGFTLRYKTWFDTLTVEVADKAAVLARAEKAEINLRTDTYGAVGITLSEATRRDDVIKLFSVLTGTDDKLDVEALDKELMTESHSIPASMLRSDEILLHPNFNRYHSETDMMRYMHRLERRDLALNQAMIPLGSCTMKLNAAAEMLPISWPEFNELHPFCPPEQAQGYQQMISQLSHWLVQLTGYDVVCMQPNSGAQGEYAGLLAIRRYHESRGEGHRHICLIPSSAHGTNPASAHMAGMTVVVVSCDKEGNIDLVDLREKAEESGNELSCIMVTYPSTHGVYEETIRQVCEIIHQYGGQVYLDGANMNAQVGITAPGFIGADVSHLNLHKTFCIPHGGGGPGMGPIGVKAHLAPFLPGHSVVQMDGLTEQRAVSAAPFGSASILPISWMYIRMMGSQGLKQASQTAILNANYIAARLKNDYDVLYTGHNGYVAHECILDIRPLKEEFGISEMDIAKRLIDYGFHAPTMSFPVAGTLMVEPTESESKVEIDRFVDAMLAIRAEIGKVAKGEWSLEDNPLVNAPHVQAELVSDWSHSYSRETAVFPTLETKANKYWPAVKRLDDVYGDRNLHCSCAPVSDYQ

SEQ ID NO: 29895 - protein, 109 aa, Glycine max
  misc_feature (28)..(28): Xaa can be any naturally occurring amino acid
  misc_feature (44)..(44): Xaa can be any naturally occurring amino acid
  misc_feature (80)..(81): Xaa can be any naturally occurring amino acid
EIFGGYLYFHKAPNKEEFHIETYHKIKXLHQYNYLRANKSTFTXNLEAHIPFLDKAFINTTISINPKSKIIKRNKRRIKXXILKRAFNNKEHPYLPKHILYRQKKQFSN

SEQ ID NO: 29896 - protein, 391 aa, Methanocaldococcus jannaschii
  misc_feature (334)..(334): Xaa can be any naturally occurring amino acid
MVKYMVLKIKDNIYCMSFIEWKIKEYRGLDIEKGTTYNSYLILDKNNVIIDTTRIKYFDELLSYLKDVANLKLDYIISNHISPDHNECIEKLIELTEAKIVTTKIRKYYLDAQFNTKDWEFVIVKNGDELNIGNRTLKFITDDKCEYMLTYCVEDKILFSNDLFSQHVVYKEKIDSDIGHKIMLDAKEYFANILLPYRKSILKILNILKDLDLEYICPSHGVIWHIMIDEILTKYRMWCSDSYKNTAVIVYATIYSSTEKIAKALGEGLSEEGVDVIYHRLDTSPLNIIMRDILDAKYVLVGSPTINMNVHPKVGMLLTYIEGLKPSNKKIGVXFGSYGWKECATKKIIEAFKRLGFKIVDDKILTFRFAPKENDIKKIKEFGRKLAKINV

SEQ ID NO: 29897 - protein, 274 aa, Glycine max
MWSALKRNYEVSEEIGRGRFGTIFRCFHPLSNQPYACKLIDKSLLLDSTDRHCLQNEPKFMSLLSPHPNILQIFHVFEDDHYLSIVMDLCQPHTLFDRMLHAPFSESQAASLIKNLLEAVAHCHRLGVAHRDIKPDNILFDSADNLKLADFGSAEWFGDGRSMSGVVGTPYYVAPEVLLGREYDEKVDVWSCGVILYIMLAGIPPFYGDSAAEIFEAVVKANLRFPSRIFRTVSPAAKDLLRKMISRDSSRRFSAEQALRHPWILSAGDTAELT

SEQ ID NO: 29898 - protein, 497 aa, Taxus cuspidata
MDSFIFLRSIGTKFGQLESSPAILSLTLAPILAIILLLLFRYNHRSSVKLPPGKLGFPLIGETIQLLRTLRSETPQKFFDDRLKKFGPVYMTSLIGHPTVVLCGPAGNKLVLSNEDKLVEMEGPKSFMKLIGEDSIVAKRGEDHRILRTALARFLGAQALQNYLGRMSSEIGHHFNEKWKGKDEVKVLPLVRGLIFSIASTLFFDVNDGHQQKQLHHLLETILVGSLSVPLDFPGTRYRKGLQARLKLDEILSSLIKRRRRDLRSGIASDDQDLLSVLLTFRDEKGNSLTDQGILDNFSAMFHASYDTTVAPMALIFKLLYSNPEYHEKVFQEQLEIIGNKKEGEEISWKDLKSMKYTWQAVQESLRMYPPVFGIFRKAITDIHYDGYTIPKGWRVLCSPYTTHLREEYFPEPEEFRPSRFEDEGRHVTPYTYVPFGGGLRTCPGWEFSKIEILLFVHHFVKNFSSYIPVDPNEKVLSDPLPPLPANGFSIKLFPRS

SEQ ID NO: 29899 - protein, 379 aa, Lactococcus lactis
MNNTEYYERLGVDKNASQDEIKKAYRKMSKKYHPDLNKEEGAEEKYKEVQEAYETLSDEQKRAAYDQYGEAGANGGFGGGGFGGASGFSGFGGGSGGFGGFEDIFSSFFGGGGAQVNPNAPRQGDDLQYRINLKFEEAIFGVEKQVKYNREELCHTCGGSGAKAGTHPETCHKCGGRGQINVVRDTPLGRMQTQVTCDVCNGTGKEIKEKCETCHGSGHEKVAHTVKVTVPAGVETGQKMRLQGQGDAGVNGGPYGDLYVVFQVEASDKFERDGAEIYYKMPMDFVQAALGDEIEVPTVHGNVKLKIPAGTQTGANFRLKGKGAPKLRGSGNGDQYVIINIVTPKNLNQAQKEALQAFAKASGVEVSGSGKKGFFDKFK

SEQ ID NO: 29900 - protein, 419 aa, Desulfitobacterium hafniense
MHYVIIGNSAAGVFAAEAIRGLDSSGKITIISEENNRPYSRCLTSYYIGEEIDQDRIYIRDANFYAATGIDFIPQKVEQVNDTEKSVTLQSGEIVGYDKLLIATGASPYSLPVEGLDLEGVCELRTLEDARRIMDFAPHVKEAVVMGAGLVGLKGAHALHELGIKVSIIVNSRIMSRSVDPHTGQIITELLEQDGYEVIYNTKLSKILGQDKVEGVCLSSGKEIPCQLVLMAAGVSPNVDLVKNTGIEVNKGIIVDKHMQTTVPHIYAAGDVAEAYHAVWDEKRVISIWPVATAQGTVAGSNMAGVERIYEGSVGSNSAVFCGVGVVSAGIPYLPTGEGQELSTYDKVTKRYRKFIVKDDILVGMIMVGDIDGAGILTAMIKQKTKVSLDTLNYWLNHPVRFQGYCTAEAKGGIVCGIC

SEQ ID NO: 29901 - protein, 294 aa, Saccharomyces cerevisiae
MKTLVHVASVEKGRSYEDFQKVYNAIALKLREDDEYDNYIGYGPVLVRLAWHISGTWDKHDNTGGSYGGTYRFKKEFNDPSNAGLQNGFKFLEPIHKEFPWISSGDLFSLGGVTAVQEMQGPKIPWRCGRVDTPEDTTPDNGRLPDYDKDAGYVRTFFQRLNMNDREVVALMGAHALGKTHLKNSGYEGPWGAANNVFTNEFYLNLLNEDWKLEKNDANNEQWDSKSGYMMLPTDYSLIQDPKYLSIVKEYANDQDKFFKDFSKAFEKLLENGITFPKDAPSPFIFKTLEEQGL

SEQ ID NO: 29902 - protein, 847 aa, Musa acuminata
MGKIKGKQRQDKFYYLAKEQGYRSRAAFKLLQLDAKYRFLPSARSILDLCAAPGGWLQVAVRHAPVGSFVIGVDLFPIRPVRGAHALVEDITTPRCRAAIKRLMDSNGCSAFDVVLHDGSPNVGGAWAQEATSQSSLVVDSVRLATNFLAPKGTFVTKVFRSQDYSAIIYCLKQLFEKVEVTKPVASRSTSAEIYVIGLRYKAPAKIDPRLLDMKHLFQGAIEHPKVVDVLRGSKQKRNREGYEEGNTTLWKVGLVSDFVWSEAPLEFLGSVNALSFDDPACLPIRDHEFTTDEVKSLCEDLYVLDKSSFKHLLKWRMHIKKALASADKAVPKVDEDAPKVDDAEDDTKGNDDDSLLNEMEELAHLLDRKKKKAKKLLSKRRAKEKARRAMGMQIDATEDSYFDRDLFSLSAIKGKKELSAIDSAELDDEYSKGDAADSEDETQTAMLHDDSSSEMDSDEEQKRYDAQLEEMLDEAYERYVIRKGGNTKKQKRAKRDKASNDVDILEGDNGDGLVDDEIDQHLSAKESNPLVVPLDEDEQPTTEQLVERWFSQDVFTEAPTDDAFEKSDSEDEKEEKFVKVPAKSVGNMKQSKDLTLPISKKPEEEDFEIVPAERMETSDDSSSSSDESEEMDDDSKAEILAYAKKMLRKKQREQILDDAYNKYMFDDEGLPKWFADEEKQHCQPTKPITREEVAAMKAQFREIDARPAKKVAEAKARKKRAAMRKLEKVRQKANTIADQTDISERSKGKMIDRLYKKAMPKKPKKEYVVAKKGVRMKVGKGKVLVDRRMKKDARSRGTGRPGKGGLKKGKGANGQKGQKGQKAKQSAKSPRKGVGKGRKNKGQMQE

SEQ ID NO: 29903 - protein, 304 aa, Mycobacterium leprae
MAKWTTADIPDQTGRVAVITGANTGLGYQTALALAEHGAHVVLAVRNLDKGKDAAARITATSAQNNVALQELDLASLESVRAAAKQLRSDYDHIDLLINNAGVMWTPKSTTKDGFELQFGTNHLGHFAFTGLLLDRLLPIVGSRVITVSSLSHRLFADIHFNDLQWECNYNRVAAYGQSKLANLLFTYELQRRLATRQTTIAVAAHPGGSRTELTRTLPALIAPIFSVAELFLTQDAATGALPTLRAATDAAVLGGQYFGPDGFAEIRGHPKVVASNGKSHDVDRQLRLWAVSEELTGVVYPVG

SEQ ID NO: 29904 - protein, 262 aa, Staphylococcus epidermidis
MVHMGKVYLVGAGPGDPELITLKGLKAIKEADVILYDRLVNKEILNYASPSTKFFYCGKDPHRHSLPQEETNKMMVTLAKKGHIVTRLKGGDPFVFGRGGEEAEELACHNIHFEIIPGITSGIAAPAYAGIPVTHRDYSSSVAFVTAVNKPGMDKGKYWQHLANGPETLCIYMGVKRLSEICELLIQYGRSSETPVALVHMGTSKQQMTVTGTLDTIQERAHHIQNPAMIIVGEVVKMREKINWFVEQATVQNETLTEMSST

SEQ ID NO: 29905 - protein, 144 aa, Glycine max
  misc_feature (13)..(13): Xaa can be any naturally occurring amino acid
  misc_feature (17)..(17): Xaa can be any naturally occurring amino acid
  misc_feature (29)..(29): Xaa can be any naturally occurring amino acid
  misc_feature (32)..(33): Xaa can be any naturally occurring amino acid
  misc_feature (60)..(60): Xaa can be any naturally occurring amino acid
  misc_feature (75)..(75): Xaa can be any naturally occurring amino acid
  misc_feature (77)..(77): Xaa can be any naturally occurring amino acid
  misc_feature (87)..(87): Xaa can be any naturally occurring amino acid
  misc_feature (89)..(89): Xaa can be any naturally occurring amino acid
  misc_feature (99)..(99): Xaa can be any naturally occurring amino acid
  misc_feature (102)..(102): Xaa can be any naturally occurring amino acid
  misc_feature (109)..(109): Xaa can be any naturally occurring amino acid
  misc_feature (113)..(113): Xaa can be any naturally occurring amino acid
  misc_feature (123)..(123): Xaa can be any naturally occurring amino acid
GSVHEEVTLRVLXDPEXENLPAARIAALXKEXXLLLDWQKIGPGEFREVPEGDFLGEVTXCDLVICHFFPWEFFXCXNLAKLLKSLXPXPLVPKFIKLXAAXAPFFVPXLALXTLPCVLLFRXGVPAARLVGFPALGGLAVFSP

SEQ ID NO: 29906 - protein, 336 aa, Roseovarius nubinhibens
MGLIFYFTLMFCLSSSDLDAEQEGMMARKEIFAVAQMGPVHLADTKAQVVARLIDMLREAHGRGARWVTFPELALTTFFPRYIYDTPEEYDQFFEEGLPSPAMQPLFEVARDLGVGFYLGYAEKTEDAGQTRRFNTSVLVGPDGALLGKYRKIHLPGTVDPIGDLEFEHLEKRYFEVGDLGFPTFATPSGRFGMCICNDRRWPETFRVMALRGAEVFMLGYNTPTRNIHHPEPAHLREFHNRLSLESAAYQNGAWVMAAAKCGSEDGFAMIGGSAIVAPTGEVVARAVSEEDEVISYDCDLDLGAYIRRSVFDFARHRRIEHYGPITDQTGVEVPS

SEQ ID NO: 29907 - protein, 637 aa, Cryptococcus neoformans
MSPTAIIDNHKVDLADLKSKVVDGHVELEETPKPPVADNFMYDFKYNHALPTTDALGVSIPDDVDAQNAAEEIVAKLSKVLSEGDAKGFTGLFLEYGVWRDKLAFTWDYRTFNFTENIARAAADLLPSTHCTNFKLLKPAPAIQKPYPDLSFLQFVLSFDTPLVQASAVINAVFTQEGWRLWTVHSVAESLLKFPELDPADGHMTGPVSWEKQREMDDEEIVPDVLIVGGGQNGLALAARLKALGVPNLIVERNAQIGEIWRKRYEYLSLHFPHWADHFPYFPFPKYWPTYTPAQKLGIFMEWYASAMELPVWTKSTVVKAEQDADGKWTVEVNKNGETRVLNPKHVVMATSLCGVPMTPVIPGMDKWKGTARHSTSHDSSREWVGKKVLVVGTSSSGFDTAYDCARRNIDVTLLQRSPTYIMSLTHSVPRNIGSFEPKNGVAPNIEEQDRLFNSMPVGPGEELARRNRAVLEELDKEMLDGLRAKGLKTYKGQRGTGQATLGSTRNGGFYFEAGACEQIIKGKIKVEQGYVESFTEDKVILSGGREREFDLVVFATGFSNTIDSVRQTLGDKIADQCGPIWGVDEEGEMKSAWKECGVPNLWLVIGYLPLTRYHSKLVALRIKALLEGVSPAPYKA

SEQ ID NO: 29908 - protein, 637 aa, Lotus uliginosus
MQQKNLSAQLAVAVRSIQWSYGIFWAPSTTQQRELEWRDGFYNGDIKTMKTVQTMETKADKIGLQRSEQLRELYRFLLEGEADPQAKRPSASLSPEDLSDSEWYYLVCMSFVFYPNQSLPGKALEIGETVWLCNAQQADSKFFSRSLLAKSASIQTVVCFPYLGGVIEIGTTEVVSEDPNLIQHVKTCFLEVSKPTCSDKSSSAHDKPHDDNKYPTCTKGDHEVFDKMPLENSCSFAEELKFDEYPGRELQDDDNNEDCDMDGFSDGGYDHYESMIEGINEGGSSQVHFVNDGGEINGAPDSLSSCDCMSEAFDNHGKKDSKNVTQIQQRELLDCDDHSKSSSLDIGADEDLYYTKTLCAILGNSSSFAQNLCASKSSFVKWKKGGVSERKRPWLQQMMLKKTLFDVPFMHLSCSSLKLQKENGRKEWTSKLENADNFMGNVFSDKKRESRNIQVLKSVAPSACEVEKISVLGGTIKYLKNLEARVEELESYMDTTATGARTKRKCPDVLEQISDNYGPSNIYMGMKKPMINKRKACDIDNIDTGLDIIVSEEDKPLDVKVNMKEEEVLIEMKCPYREYILYDIMDAINNLHIDAHTVDSSTADGVLTFKLKSKFRGAATAPVRMIKEALWKVSGKI

SEQ ID NO: 29909 - protein, 509 aa, Lotus japonicus
NGDIKQMKTVQTMETKADKIGLQRSEQLRELYKFLLVGEADPLAKRPSASLSPEDLSDSEWYYLVCMSFVFYPNQSLPGKALETGETVWLCNAQQADSKFFSRSLLAKSASIQTVVCFPYLGGVIEIGTTELVSEDPNLIQHVKACFLEISKPTCSDKSSSGHDKPHDDHQYPTCTKGDHEGLDKIPMENSCSFAEELKFDEYPGRELQDDDNNEDCDMDGFSDGGCDHYESMIEGINEGGSSQVHFVNEGGDINGAPDSSSSCDCRSEASENHGKKDSKNVIQIQQKELQDCDDNSKSSSLDIGADEVLYYTRTLCAVLGNSSSFAQNLCASKSSFVKWNKGGVSERKWPRLQQMMLKKTLFDVPFMHLSCSSLKLQKENGRKEWTSKLENADNFMGNVFSDKKRESRNIQVLKSVAPSACEVEKISVLGDTIQYLKKLEARVEELESYMDTTATGARTRRKCPDVQEQISDNYGPSNIYMGMKKSRINKRKACDIDDIDTGLDIIVS

SEQ ID NO: 29910 - protein, 264 aa, Burkholderia xenovorans
MAPAMHVAMTRAWLIGAGPGDVELMTLKATRALAQADVVLVDDLVNPDVLQFARADARIVHVGKRGGHPSTPQEGIVAQLLEHVRAGRSVARLKGGDPFVFGRGGEEQQALHAAGIEVEVINGITAGIAAPAAIGIPVTHRDHAQGVVFVTGHGAGSAEPAWAALVATRMTLVIYMGMRRLGDIVDALLAAGMSAETPCAAIESATRPGQRHVLARLGEFAGSVSRAGLGSPAIVVIGGVASLALARDAAYADAATLPANGDVA

SEQ ID NO: 29911 - protein, 338 aa, Oryza sativa
MPNLECRMYEAPFPEVETAVMIQVKHLAELGAYVSLLEYNNIEGMILYSELSRRRIRSIPSLIKVGRQEPAVVLRVDHDKGYIDLSKRRVSHHDRRTCEDRYSKSKFVHSIMRHLAETLHLDLEPLYHRIAWPLYRTYGHAFDAFKLIVADPDAAILDSLTYDLTETGPDDQEVTKTLPAVTPEIKDALIKNIRRRMTPQPHKIRADIDMKCFQYDGVLHIQEAMRKAEAAGNKDCPVKIKLVAAPLYVLTTETLDKHQGISVLNNAIKACGETIEKHKGKLVVKEAPRAVSEREDRLFMDDIEKLKIANEEVDGDEDSEEDTGMGDVDLTKTGVGSQ

SEQ ID NO: 29912 - protein, 381 aa, Kluyveromyces lactis
MQIFVKTLTGKTITLEVESSDTIDNVKSKIQDKEGIPPDQQRLIFAGKQLEDGRTLSDYNIQKESTLHLVLRLRGGMQIFVKTLTGKTITLEVESSDTIDNVKSKIQDKEGIPPDQQRLIFAGKQLEDGRTLSDYNIQKESTLHLVLRLRGGMQIFVKTLTGKTITLEVESSDTIDNVKSKIQDKEGIPPDQQRLIFAGKQLEDGRTLSDYNIQKESTLHLVLRLRGGMQIFVKTLTGKTITLEVESSDTIDNVKSKIQDKEGIPPDQQRLIFAGKQLEDGRTLSDYNIQKESTLHLVLRLRGGMQIFVKTLTGKTITLEVESSDTIDNVKSKIQDKEGIPPDQQRLIFAGKQLEDGRTLSDYNIQKESTLHLVLRLRGGI

SEQ ID NO: 29913 - protein, 321 aa, Brassica napus
MEKQSTSSSSSSSSSWIRGSCIGRGCFGTVSKAVSKIDGGVFAVKSVDLATCLPSQSESLENEIAILRSLKTHPHIVRFLGDDVSNEGTTSFRNLHLEYLPEGDVANGGKIVNDETLLRRYVWCLVSALGHVHANGIVHCDVKSKNVLVANGGSSVKLADFGSAVELENPTAAIAPRGSPLWMAPEAVRGEYQGPESDVWSLGCTVIEMLTGKPAWEDNGFDSLSRIGFSSELPFIPAGVSELGRDFLEKCLRRDRSQRWSCDQLLEHPFLCQDHHSFVTESSPRCVLDWVNSDFEEDEVSDVSRVEPMVSAMASARVFPV

SEQ ID NO: 29914 - protein, 1094 aa, Unknown
  Photobacterium sp. SKA34
MKRMLINATQKEELRVALVDGQKLFDLDIESPGHESKKANIYKGRITRIEPSLEAAFVDYGAERHGFLPLKEVAKDYFPANYSYQGRPNIKEVLKEGQEVIVQVDKEERGNKGAALTTFISLAGSYLVLMPNNPRAGGISRRIEGEERTQLKAALSTLDLPQGMGLIVRTAGVGKSGEELEWDLNVLLNHWNAVKEAADSQSAPFLIHQESNVIARAIRDYLRRDIGEILIDSPKIFDRARDHIKLVRPDFLSRVKRYEGEVPLFSHYQIESQIDSAFQREVRLPSGGSVVIDPTEALTSIDINSARATKGGDIEETALQTNLEAADEIARQLRLRDLGGLVVIDFIDMTPVRHQREVENRLREAVRMDRARVQIGRISRFGLLEMSRQRLSPSLAEASHHVCPRCSGTGVVRDNESLSLSILRLIEEEALKDNSSQVLAIVPVPVASYLLNEKRRSVQHIEKYHGVRVVIVPNSDMETPHFEVLRIREGEEQDTLSYHIPKTLEALKEAEAIEIPQPERVIKKREEPVLQGFTAPKQPAPVAKPAAKPTPKVAAKPVTESTQKPGLLSRFFSALASFFSGSPEQQQEKPVEAKAEQNNNQNNRRNNNRRNDRSDNRRNNRDNSRDNNRRNSRQDNNDVENNDERQERNNEQRQNRRRNDRNDKNRQQQNDKAAKAPRQNRNNDEAKEQKRQSRKEEIQAQKQQRQQQGEQIAKATTEQPADAQRDSEEKAVKVKQRRQRRQLRKKVRITDNVEKSVEQQNVAVDAVEKVEAVETVVEQTPSPLMALGTSIAKEAQDKPEQTQSVTDEQTDNEEQEGTQRRNRRSPRHLRASGQRRRRMRDTRVEKSDFVTNEEANAIEQAAVDAADSISEMVNVVSIVEKPKTMRPTSGVAIPEMAMGKVWSRIKPAVEATVEKNITKEKADTADVIDEVETNDIIINTPIVEAKSEVVAVEARTLSGVAIPEMAMGKVFPRFTAEETTVEIKSEPAVESVIKQPVIVEEVAAPVIKIEETVEIKSPVAPVVDLPAVATAVMATSPRGFHAASAMTKAPAPEEHVSGSVVQAAPLRERTNTRAAGSQTATNSAAAPMTKPSFD

SEQ ID NO: 29915 - protein, 93 aa, Unknown
  Synechococcus sp. CC9311
MASFTISIEGGSSFSCADDQYILDAAEEQGIDLAYSCRAGACSTCAGKILKGSVDQADQSFLDDDQMSKGLSLLCVSYPLSDCLIKTSVEDEL

SEQ ID NO: 29916 - protein, 224 aa, Oryza sativa
MGRRPARCYRQIKNKPYPKSRYCRGVPDPKIRIYDVGMKKKGVDEFPYCVHLVSWEKENVSSEALEAARIACNKYMTKNAGKDAFHLRVRVHPFHVLRINKMLSCAGADRLQTGMRGAFGKPQGTCARVDIGQVLLSVRCKESNAKHAEEALRRAKFKFPGRQKIIHSRKWGFTKFTREEYVKLKAEGRIMSDGVNAQLLGSHGRLAKRAPGKAFLAETIQASA

SEQ ID NO: 29917 - protein, 305 aa, Unknown
  Synechococcus sp. CC9311
MDGAGFTIDDFASLLSKYDYNFKPGDIVNGTVFALETKGAMIDIGAKTAAFMPLQEVSINRVEGLSDVLQPGEIREFFIMSEENEDGQLSLSVRRIEYQRAWERVRQLQKEDATIYSEVFATNRGGALVRVEGLRGFIPGSHISTRKPKEELVADFLPLKFLEVDEERNRLVLSHRRALVERKMNRLEVGEVVIGTVRGIKPYGAFIDIGGVSGLLHISEISHEHIETPHSVLNVNDQMKVMIIDLDAERGRISLSTKALEPEPGDMLTDPQKVFDKAEEMAARYKQMLLEQAEEGEEPLSSMMV

SEQ ID NO: 29918 - protein, 625 aa, Lactococcus lactis
MCGIVGFIDRMNQNDKSKTLEEMMNTIGHRGPSSSGEFIDEGAAIGFRRLSIIDLEGGDQPIFNEDKSKLITFNGEIYNFRELREDLIAKGHDFTTHADTEVLLHGYEEYGVELLQKLRGMFAFVIWDREKQELFGARDHFGIKPLYYTQMGGTFMYGSEIKSFLKHPNFKKELNKEALKPYMTFQYSALDETFFKNVFRIKEGHYFTYKDGVLDIKPYWDMKVDEKDMSLEESIDLIDKTVLGSVDAHKFADVEVGAFVSSGVDSSYVASTLRPEHTYSIGFGQGTFNESKQAKQLTDMIGLNNTSREIHGDEAFKYFPQIQYYLDEPDSNPSCVPLFFLAELAARDVRVVMSGEGADELFAGYESYGFSTNSRAVRVFAEGLKKLPKSLRFSIARGIENKHFKGQKHLYESLAPAEDFFIGQAKVFDESESVELLKEEFKAAPTVKDIVGKTYKKAPEGSELRKMQYLDMHQWMPGDILLKADKMAMAHSLELRVPLLDIELMHTAEQIPTKYLLNEHNTKYAFRQAARRHLPEEWSNRKKLGFPVPIKDWLREEKYYKVVRQLFEQDFVAEFFDQEKLLKMLDDNFADKNDARRKLWTIYSFLTWYDVYFINNGEKPAVVNF

SEQ ID NO: 29919 - protein, 428 aa, Musa acuminata
MKLLVVVLVLLFCPHHGVEAAGGEFIGISGLHFVLNGNPFFANGFNAYWLMTLASDPSQRDKVSSALSDASSHELSVARTWAFSDGGSNALQYSPGSYNEQTFQGLDFVVSEAGKYGIRLILSLVNSYDNYGGRKQYVQWARDQGHEIGSEDEFFTDPVVKGYFKDHVKTVLTRVNNITGVAYKDDPTVFAWELMNEPRCPSDLSGKSIQDWITEMAAYLKSIDSNHLLEAGLEGFYGESSPQKQANPGFQVGTDFIANNQIPGIDFATLHSYPDQWLPNSDDQSQLAFLNNWLDVHIEDARFVLRKPLLVTEFGKSSKDPGFSSEQRDAMFGAVYSKIYSSASSGGATAGSCFWQLMAQGMDSYRDGYEVVLSEAPSTTRIITVQSRQLRYLGRLRARERNIAKLKKAKAMREKQLKAPHKGKGAGN

SEQ ID NO: 29920 - protein, 445 aa, Musa acuminata
MFGRRTADPKSVASIILGGGAGTQLVPLTSTRATPAVPIGGCYRLIDIPMSNCINSGINKIFIMTQFNSASLNRHISGTYNFGNGINFGDGFVEVLAATQTPGDAGMNWFQGTADAVRQFTWVFEDNKNKNIEHILILSGDQLYRMDYMDLVQKHVDTGADITVSCVPVGHSRASDYGLVKIDEAGRIIQFFEKPKGADLEAMNDNGTFLRLSHQDAMKYPYIASMGVYVFKRDVLLKLLRWNYPKCNDFGSEILPSAVEEHNVQAYAFSDYWEDIGTIRSFFDANLALTEQPPKFQFYDPMTPFFTSPRFLPPTKIEKCRVMDAIISHGCFLRECSVERSIVGVRSRLDFGVELKDTMMMGADIYETEAEISSHLADDKVPIGVGQKTKIRNCVIDMNARIGKNVVIANKDGVQEADRASEGFYVRSGIVVILKNATIKDGTVI

SEQ ID NO: 29921 - protein, 487 aa, Medicago truncatula
MRENISETWLVMIIVIMFTAIFAKVIQIKKRKEEKSIGRLPPGRRGWPLIGDSINWYNAVASSHPPQFVEEMVQRYGKIFSCSLFGKWAVVSSDPSFNRFVMQNEGKLFMSSYPKSFRDLVGKNGVITVQGEQQRKLHGIASNMMRLDKLKFHFMNDIQNVMIQTLSNFKNQQVILLQDVCRKVAINLMVNQLLGVSSESQVNEMAQLFSDFVDGCLSVPINIPGSSYHTAMKAREKIISKINKIIEVQRQNGPPKEGNNGVLGRLIEEDSLPDDAVADFIINLLFAGNETTTKTMLFAVYFLTQCPNAMEQLLDEQDSLRTKSAEESLTWQDYKAMPFTQCVIDETLRLGGIAIWLLREAKEDIQYQDFVIPKGCFVVPFLSAVHLDEKVYNEAKNFNPWRWMEPENEEKRNWRSSPFYAPFGGGARFCPGAELARLQIALFLHYFVTNYRWKQMKEDRMSFFPSARLVNGFEICLTKRHDNNQRN

SEQ ID NO: 29922 - protein, 304 aa, Arabidopsis thaliana
MWFFGSKGASGFSSRSTAEEVTHGVDGTGLTAIVTGASSGIGVETARVLALRGVHVVMAVRNTGAGAKVKEDIVKQVPGAKLDVMELDLSSMQSVRKFASDNNAGIMACPFMLSKDNIELQFATNHLGHFLLTKLLLDTMKSTSRESKREGRIVNLSSEAHRFSYPEGVRFDKINDESSYSSMRAYGQSKLCNVLHANELAKQLKEDGVNITANSLHPGAIMTNLGRYFNPYLAGAVGAVAKYMLKSVPQGAATTCYVALNPQVAGVSGEYFPDSNIAKPLPLVKDTELAKKLWDFSTKLTDSQ

SEQ ID NO: 29923 - protein, 325 aa, Zea mays
MGEASPSIAKDVTELIGNTPLVYLNKVTDGCVGRVAAKLESMEPCSSVKDRIGYSMITDAEEKGLITPGVSVLIEPTSGNTGIGLAFMAAAKGYKLTLTMPASMSMERRIILKAFGAELVLTDPLLGMKGAVKKAEEIQAKTPNSYILQQFENPANPKIHYETTGPEIWKATAGKIAGLVSGIGTGGTITGTGRYLREQNPNVKLYGVEPVESAVLNGGKPGPHKIQGIGAGFIPGVLDVDLLDETLQVSSDEAIETAKALALKEGLLVGISSGAAAAAAVRLAKRPENAGKLFVVVFPSFGERYLSSVLFQSIKKEAESMVVEP

SEQ ID NO: 29924 - protein, 265 aa, Musa acuminata
MAATMALSSPSFAGKAVKLAPSASGVLGQGRVTMRKAGGKPAASSGSPWYGPDRVKYLGPLSGEPPSYLTGEFPGDYGWDTAGLSADPETFAKNRELEVIHCRWAMLGALGCVFPELLARNGVKFGEAVWFKAGAQIFSEGGLDYLGNPSLIHAQSILAIWACQVILMGAVEGYRIAGGPLGEVTDPLYPGGSFDPLGLADDPEAFAELKVKEIKNGRLAMFSMFGFFVQAIVTGKGPLENLADHLADPVNNNAWAYATNFVPGK

SEQ ID NO: 29925 - protein, 518 aa, Crocosphaera watsonii
MQDITRRVGNVSTDFKIVNSWVVILPTLLIVNCTLLNYNLSSMTNSVIFWHRRDLRVSDNIGLSKAYQHSSKLVGLFCLDTDILNQDNVAPARITYMLGCLQDLRESYQQLGGQLLIFQGNPTQIIPQVADALKVDCVFWNNDVEPYSKKRDNQVIEALQERGIHSQTYWDQLLHAPGDILTKSNNAPYKVYTPFWRSWLKEEKANIAQALGKLESLSEEEINTVKNLGIIDLPTAKDLGYSWDAPLILEPGETAAKEQLNYFCDSLIYNYQEQRNYPGINGTSTLSPAFKFGVIGIREVWQATLSAYENTYSDEARENIQTWQQEIAWREFYQHCMYFFPELATGPYRQEFKDFSWDNNEQHFQAWCEGKTGYPIVDAAMRQLNETGWMHNRCRMIVASFLTKDLIINWQWGEKYFMQKLIDGDLSANNGGWQWSASSGMDPKPLRIFNPASQAQKYDPDGEYIRLWVPEISSLDTEYLVTGKIPPLEAHSCGYLQPIVDHKQQQREFKERYKQIKN

SEQ ID NO: 29926 - protein, 495 aa, Unknown
  Pseudomonas sp. MT-1
MRVSTLFEWKRPEIRALHLTWIAFYICFFVWFGMAPLASSMLKSVNWLTPEDLKLFAIANVALTIPARILVGMALDHWGPRRVFSVLLVTMAAPALFFAFGDSRTQLLVSRLILGSIGASFVVGIHMTAMWFKPKDIGFAEGFYAGWGNFGSAAAAMSLPAIAIHAFGGPEGWRWAIASSAIIMAVYGVYYWFALTDGPVGTIHRKPHKASALEVSTWADMVKLIIWTIPMVGVLGILVWRIEGLGYLGATGAAICYSVIALVVIFQVVQILRVNIPILKKGVPEDDKYPFNTVAALNSTYFANFGAELAVVSMLPMFFELTWGLTPTTAGIIAASFAFVNLVARPMGGLVSDRFGNRRFVMLAYMLGIAVGFFLMGLMNASWPLIVAVAITVACSMFVQGAEGATFGIIPSIKRRVTGQISGMAGAYGNVGAVCYLTLYTFVTPSQFFMVIAAGAFVSFGLCLLWLKEPEGAFSDEYYVSSVDRELEARQKLAS

SEQ ID NO: 29927 - protein, 87 aa, Taraxacum officinale
KTKAVATTTPSVTQTSKGGKKTLRKGTVIITGASSGLGLATARSLAETGKWHVIMACRDFLKAERAAKSSGMPKENYTVMHLDLASF

SEQ ID NO: 29928 - protein, 253 aa, Zea mays
MATSSAMSLQSISKTSLGNLSHNHHFHRSSFLGSSRSFQNLGISSNGPDFSSQSRSTSKNLSPTRAFFWNWGKSENARPSKVQELNVYELNEGDRNSPAVLKLGKKPELCLGDLVPFTNKLYTGDLKKRVGITAGLCVLIQHVPEKNGDRFEATYSFYLGDYGHLSVQGPYLTYEDTFLAVTGGSGIFEGAYGQVKLRQLVYPTKLFYTFYLKGIADLPLELTGTAVSPSKDVKPAPEAKATEPGATIKNFTN

SEQ ID NO: 29929 - protein, 274 aa, Hyoscyamus niger
MAGESEVYINGNNGGIRWSLKGTTALVTGGSKGIGYAVVEELAGLGARVYTCSRNEKELQQCLDIWRNEGLQVEGSVCDLLLRSERDKLMQTVADLFNGKLNILVNNAGVVIHKEAKDFTKEDYDIVLGTNFEAAYHLCQLAYPFLKASQNGNVIFLSSIAGFSALPSVSLYSASKAAINQITKNLACEWAKDNIRVNSVAPGVILTPLIETAIKKNPHQKEEIDNFIVKTPMGRAGKPNEVSALIAFLCFPAASYITGQIIWADGGFTANGGF

SEQ ID NO: 29930 - protein, 320 aa, Wolbachia pipientis
KAVMEAQGSFLTNKYAEGYPGKRYYCGCEHVDKIESLAIERLCKLFGVKFANVQPHSGSQANQAVFASLLTPGDTILGLSLSCGGHLTHGAAPSLSGKWFKSIQYTVNKDTYLLDMDEIEKLALEHKPKLIIAGASAYPRKMDFKRFREIADKVGAYLLADIAHYAGLIAAGEYPSPAEYAHVMTSTTHKTLRGPRGGIVMTNDEILHKKIQSAVFPGLQGGPLMHVIAAKAVAFKEALAPGFKTYSKKVVENAKVLAQELQKHGLDIITGGTDSHIVLVDLRSQKLTGKDVVDSLERAGITCNKNSVPFDTAKPTITSG

SEQ ID NO: 29931 - protein, 260 aa, Picea glauca
MEDMNMNIGGAATFYGVNMNEYGDTGVGSMMALMTEQEPGNESIMSTMTMTIPSSAFSSYSHAGQVEGLLSAAAATMFNQGGHHHHQKHLVGGHFPPEQLVMNEQAAVISDSSLSSVKTEVCSNQLEFHRKTSGGGRSCCPQPSLVVRAPQQHHHHHHHQEASRMVTSLEVDIDSACSSNPNDSIDTLKTKIACHPHYPQLLAAYMDCQKIGAPPEVVTVLDEISQENQLGRHLATMDIGVDPELDQFMEAYCQMLIKYH

SEQ ID NO: 29932 - protein, 319 aa, Lactobacillus johnsonii
MKRIGILTSGGDAPGMNAAIRAVTRTALANGIEVCGIRYGYAGLVAGDIFQMTSETVADKISRGGTFLYSARFPEFKEEEVQLKGIEQLKKHGIDALVVIGGDGSYHGALKLTRHGYNAIGLPGSIDNDIPYTDYTIGFDTACNTAMEAIDKIRDTATSHQRVFVVNVMGRDCGDIAMHVGVATGADAIVIPEEPYDIKEIAENLKQGFANGKKHGIVVLAEGVMDAEKFKDELLKYGDFDARANVLGHMQRGGSPTMRDRVVASEMGAYAVKLLLEGKGGLAVGMENNKLTHHDILDLFDAKHHGNYALYSLNKDLAK

SEQ ID NO: 29933 - protein, 317 aa, Treponema denticola
MIKEIYLAGGCFWGVEGYFRQIPGVKETDTGYANGKNDSANYKGLHQSDHAETVKIVYDSSVVSLQELLAHYFRIIDPTSLNKQGNDAGRQYRTGIYYVDDSMIKEINSFVKFMQKKYSRPIVVEVEKLKHFILAEDYHQDYLQKNPGGYCHIDLTLALKPLYDESKFKVPSKEELKKSLKPIQFSVTQEKATERPFTSEYDKFDAEGIYVDITTGKPLFSSLNKYDAGCGWPSFTKAITTQALQYLEDKSLGMNRTEVVSKTGGAHLGHVFDDGPADAGGLRYCINGAALRFIPYDKMEKEGYGDYLPYVKPTGNF

SEQ ID NO: 29934 - protein, 828 aa, Escherichia coli
MKLSRRSFMKANAVAAAAAAAGLSVPGVARAVVGQQEAIKWDKAPCRFCGTGCGVLVGTQQGRVVACQGDPDAPVNRGLNCIKGYFLPKIMYGKDRLTQPLLRMKNGKYDKEGEFTPITWDQAFDVMEEKFKTALKEKGPESIGMFGSGQWTIWEGYAASKLFKAGFRSNNIDPNARHCMASAVVGFMRTFGMDEPMGCYDDIEQADAFVLWGANMAEMHPILWSRITNRRLSNQNVTVAVLSTYQHRSFELADNGIIFTPQSDLVILNYIANYIIQNNAINQDFFSKHVNLRKGATDIGYGLRPTHPLEKAAKNPGSDASEPMSFEDYKAFVAEYTLEKTAEMTGVPKDQLEQLAQLYADPNKKVISYWTMGFNQHTRGVWANNLVYNLHLLTGKISQPGCGPFSLTGQPSACGTAREVGTFAHRLPADMVVTNEKHRDICEKKWNIPSGTIPAKIGLHAVAQDRALKDGKLNVYWTMCTNNMQAGPNINEERMPGWRDPRNFIIVSDPYPTVSALAADLILPTAMWVEKEGAYGNAERRTQFWRQQVQAPGEAKSDLWQLVQFSRRFKTEEVWPEELLAKKPELRGKTLYEVLYATPEVSKFPVSELAEDQLNDESRELGFYLQKGLFEEYAWFGRGHGHDLAPFDDYHKARGLRWPVVNGKETQWRYSEGNDPYVKAGEGYKFYGKPDGKAVIFALPFEPAAEAPDEEYDLWLSTGRVLEHWHTGSMTRRVPELHRAFPEAVLFIHPLDAKARDLRRGDKVKVVSRRGEVISIVETRGRNRPPQGLVYMPFFDAAQLVNKLTLDATDPLSKETDFKKCAVKLEKV

SEQ ID NO: 29935 - protein, 466 aa, Arabidopsis thaliana
  misc_feature (251)..(251): Xaa can be any naturally occurring amino acid
MLIKETNLGSFNLGGIFQRLLYCVPLKKSIYFVDRIGNYTDGSVSKTLNSTSSVFPQATEKENNFCLLRKGQLQDVYEHVLVNNALLICKVVLPERRISKKTLEARDPRYVNLEDKSLKVNGSSQLVNNGTRYRLEPDGNGYNYASAMKGAKVVDHNKEAKGASNVLGKDHDKYLRNPCSVSDKYVVIELAEETLVDTVRIANFEHYSSNPKEFSLSGSLSFPSDMWTPAGSFAAANVKQIQSFRLPEPKXTDQIGKETEAQKKKDDVVKTINIIGDKKYEVKEKHNVLKVMMQKVKLIEMNLSLLEDSVKKMNDKQPEVSLEMKKTLVLVEKSKADIREITEWKGKMKLPMNLIFFEQEKELRDLELWKTLVASRVESLARGNSALRLDVEKIVKEQANLESKELGVLLISLFFVVLATIRLVSTRLWAFLGMSITDKARSLWPDSGWVMILLSSSIMIFIHLLS

SEQ ID NO: 29936 - protein, 97 aa, Alocasia macrorrhizos
  misc_feature (17)..(17): Xaa can be any naturally occurring amino acid
ATYKVKLVTPQGQQEFXCPDDVYILDQAEEEGIDLPYSCRAGSCSSCAGKVKQGEVDQSDGSFLDDEQMEQGWVLTCVAFPTSDVVIETHKEEELTA

SEQ ID NO: 29937 - protein, 335 aa, Glycine max
SARAGGLGLRALSKDQLDEILKPAECTIVASLSNDYVDSYVLSESSLFVYPYKIIIKTCGTTKLLLSIPVILKLADALDIAVKSVRYTRGSFIFPGAQSFPHRSFSEEVSVLDSYFSNLGSGSKAYVMGDPSKSQIWHIYSASAQTKGSSEAVYGLEMCMTGLDKESASVFFKENTSSAASMTENSGIRKILPQSDISDFEFDPCGYSMNGIEGSAISTIHVTPEDGFSYASFEAVGYDFNDMALGELVERILACFCPAEFSVALHIDMHGEKLNKFPLDIKGYYCGERSTEELGVGGAVVYQTFVQGCDGSASPRSILKCCWSEDENEDEVREI

SEQ ID NO: 29938 - protein, 357 aa, Vibrio vulnificus
MSKQQKILFIDRDGTLIVEPPVDFQVDRLDKLKLEPFVIPSLLSLQDAGYRLVMVTNQDGLGTDSYPQEDFDAPHNMMMEIFESQGVKFDDVLICPHFEKDNCSCRKPKLGLVKEYLQAGKVDFQNSFVIGDRQTDLQLAENMAIRGIQYNPEIMGWKRILKDLTVKARVAEVVRTTKETDIKVFVNLDEQGGNAISTGLGFFDHMLDQIATHGGFQMVCKVEGDLHIDDHHTVEDTALALGQALKEALGDKRGIGRFGFSLPMDECLAQCALDLSGRPYLKFDAQFSREQVGDLSTEMVVHFFRSLTDTLACTLHLSSAGNNDHHIIESLFKAFGRTLRQAIKVEGTELPSSKGVL

SEQ ID NO: 29939 - protein, 448 aa, Thermotoga maritima
MSLKFDFSNLFEPNISGGLTDEDVKSVEEKVTSAVRNFVENTPDFAKLDRSWIDSVKSLEDWIINFDTVVVLGIGGSGLGNLALHYSLRPLNWNEMTREERNGYARVFVVDNVDPDLMSSVLDRIDPKTTLFNVISKSGSTAEVMATYSIARGILEAYGLDPREHMLITTDPEKGFLRKLVKEEGFRSLEVPPGVGGRFSVLTPVGLLSAMAEGIDIDELHEGAKDAFEKSMKENILENPAAMIALTHYLYLNKGKSISVMMAYSNRMIYLVDWYRQLWAESLGKRYNLKGEEVFTGQTPVKALGATDQHSQIQLYNEGPNDKVITFLRVENFDREIVIPETGRAELSYLARKKLSELLLAEQTGTEEALRENNRPNMRVTFDGLTPYNVGQFFAYYEAATAFMGYLLEINPFDQPGVELGKKITFALMGREGYTYEIKERSKKVIIE

SEQ ID NO: 29940 - protein, 81 aa, Novosphingobium aromaticivorans
MAKEELLEMRGTVVELLPNAMFRVRLENDHEILGHTAGKMRKNRIRVLVGDEVLVELTPYDLTKGRITYRFMPGRGGPGGF

SEQ ID NO: 29941 - protein, 75 aa, Zea mays
  misc_feature (42)..(42): Xaa can be any naturally occurring amino acid
MAALSAADASTGSGIAFEGYEKRLEITFSEAPVFVDPHGRGXACPLRAHIDSVMDLAQSTIVSELYNNDYDSYVL

SEQ ID NO: 29942 - protein, 301 aa, Unknown
  Shewanella sp. ANA-3
MNKLTDFERYVIEEKGTERPFSGEYYKHDAKGVYLCKKCHAPLYRSEDKFNAHCGWPAFDDEIPGAVSRHVDADGRRTEIVCSQCGGHLGHVFEGEYLTPKNIRHCVNSVSMVFQAADEVTTSTHKTAFATFGAGCFWCVEAIFKSLKGVLNVRSGYSGGEASDADYKSVCSGLTGHAEVVHIEFDPAQISFTTLLQVLFESHDPTTLNRQGNDKGPQYRSVVFTHDAAQIEETNTMIAKLTEAKVFDAPIVTQVVAFESFYPAEDYHNDYFALHGEQPYCQIVVRPKVEKIRALFAELQA

SEQ ID NO: 29943 - protein, 214 aa, Oryza sativa
  misc_feature (181)..(181): Xaa can be any naturally occurring amino acid
MTTVASLSLLPHLLIKPSFRCCSRKGVGRYGGIKVYAVLGDDGADYAKNNAWEALFHVDDPGPRVPIAKGKFLDVNQALEVVRFDIQYCDWRARQDLLTIMVLHNKVVEVLNPLAREFKSIGTLRKELAELQEELAKAHNQVHLSETRVSSALDKLAHMETLVNDRLSQDGGSSAYTVECXSLAPSTSSGSRVVTTRPPRRSLNVSGQCSIHPG

SEQ ID NO: 29944 - protein, 477 aa, Escherichia coli
MNKKSLWKLILILAIPCIIGFMPAPAGLSELAWVLFGIYLAAIVGLVIKPFPEPVVLLIAVAASMVVVGNLSDGAFKTTAVLSGYSSGTTWLVFSAFTLSAAFVTTGLGKRIAYLLIGKIGNTTLGLGYVTVFLDLVLAPATPSNTARAGGIVLPIINSVAVALGSEPEKSPRRVGHYLMMSIYMVTKTTSYMFFTAMAGNILALKMINDILHLQISWGGWALAAGLPGIIMLLVTPLVIYTMYPPEIKKVDNKTIAKAGLAELGPMKIREKMLLGVFVLALLGWIFSKSLGVDESTVAIVVMATMLLLGIVTWEDVVKNKGGWNTLIWYGGIIGLSSLLSKVKFFEWLAEVFKNNLAFDGHGNVAFFVIIFLSIIVRYFFASGSAYIVAMLPVFAMLANVSGAPLMLTALALLFSNSYGGMVTHYGGAAGPVIFGVGYNDIKSWWLVGAVLTILTFLVHITLGVWWWNMLIGWNML

SEQ ID NO: 29945 - protein, 430 aa, Thermus thermophilus
MDRRRFFRILGAGGLLGLLKAKAQGLPWTEETFAPTKTLGAPLAEYGERSPFEAGVVRYISPNLRTRHSGASFAPLEKLEGVITPNGLHFERHHAGAPQVDPRHYRLVIHGMVERPLVLTLEDLKRFPSVTRTYFIECAGNGQNGYRNPPDPELTATRSRGLASNASWTGVPLALLLKEAGVKPGARWLIPEGMDAAMYTRSLPLEKAMEDVLVAYAQNGEALRPEQGYPVRLVVPGWEGSIQVKWLRRILVTDLPAMAKDETSEYTDVTADGRVLAFTWVMEPQSIITYPSGGQRVQPGFHEIRGLAWSGFGRIAKVEVSFDEGRTWRKAVLEPPVEPYAFVRFKLPWYWDGKEVVLWSRAWDEKGNTQPTREEFFRRWSRNNRYHYNAIQAWRILPDGRVVNGDRPLGQGAFGPVGPVGGCGGEVLDV

SEQ ID NO: 29946 - protein, 417 aa, Blastopirellula marina
MNFIKQNDPSVWEAIAHEQRRQADGLELIASENYTSAAIQQAAGSVLTNKYAEGYPGRRYYGGCEYVDVVEQIAIDRAKELFGAEHANVQPHAGSQANFAVYLTAVNPGDTILGLDLAHGGHLTHGMKLNVSGQLYNFVSYGVDRETQRLDFDQIVKLAREHKPKLIVAGASAYPREIPHEKFAEIAAEVGAKLFVDMAHYAGLVAGGMHNSPVPYADFVTTTTHKTLRGPRSGLILCKEEHAKLINRNVFPGTQGGPLMHIVAAKAICFGEALQPSFKEYAKQVVANAKTLADTLMAGGVRLMTGGTENHLMLMDVTSVGTTGAIAEAVLDHCGITVNKNMIPFDERKPMDPSGIRIGSPALTTRGMKEAEMKQVGEWILQALKAPEDQKTHVAIRTEVLELCKNFAVPAAPVEMS

SEQ ID NO: 29947 - protein, 539 aa, Oryza sativa
  misc_feature (279)..(279): Xaa can be any naturally occurring amino acid
MSSYVTTPHHHHHHGCCSGSRRLQAPAPPARPRLVVAAAARHVALPPRRAVASRAMSAEAPLGVAPAAAEEEMAAVVDEMAEEAAVWCAVHGLVVGDRAEPRSGTIPGVGLVHAPFALLPTRFPASFWKQARELAPIFNDLVDRVSLDGEFLQDSLSRTRQVDDFTSRLLDIHAKMMEVNKEEDIRLGLHRSDYMLDSGTNSLLQIELNTISSSFPGLSSLVSELHRTLLNRHGKVLGLDSKRIPQNWAATQFAEALSMAWTEFNNKSAVIMMVVQPEXNMYDQYWLINHLKESHGVKTIRKTLAQVEAEGQVLPDGTLVVDGQTVSVVYFRAGYSPNDYPSEAEWRARLLMEQSSAIKCPSISYHLVGTKKIQQELAKPNILERFLNNKEDIAKLRKCFAGLWSLDNEEIVKTAIEKPDLFVLKPQREGGGNNIYGYDLRETLVRLQKEQGEALAAYILMQRIFPRASLTHLVQGGVCFEDLTISELGIFGAYLRNKDKVVLNNQCGYLMRTKVSSSNEGGVAAGFAVLDSILLTDEW

SEQ ID NO: 29948 - protein, 154 aa, Unknown
  uncultured archaeon GZfos3D4
MKVTLVQPNSASVIKAVLETTGVPLGLAYLGAALREEHEVRIIDALTLDYDAEELKMELKKHEPDVVGITATTPAVYDSYEVGRLAKGLNPDVKTVIGGPHVTFMAKETLEDCPALDMVVRNEGELTFKELLDAFKKGTPLKNIAGISFRKEGE

SEQ ID NO: 29949 - protein, 247 aa, Nicotiana tabacum
TVKRHVLTSVLGPNAQKRHRIHRDTLIENVSKQLHDLVRKYPNEAVNLRKIFQSELFGLALKQALGKDIESIYVEGLDATLPREDVLKTLVLDIMEGAIDVDWRDFFPYLKWVPNKSFENRIQRQHLRREAVMKALIMEQRLRINSGETLNRYIDYLSSEANTLTEQRMLMLLWEAIIESSDTTVVSTEWAMCELAKDPKRQEQLFLEIQNVCGSNKITEDKLCQLPYLCAVFHETLRKHSPVPIVP

SEQ ID NO: 29950 - protein, 504 aa, Clostridium josui
MEHGFVALVGAGPGDKGLITIRGAELLSQADVVVYDRLVSQEIIKMIPTTAEKIDVGKENKFHPVKQEEINHILLEKSLEGKKVIRLKGGDPFVFGRGGEELELLYENNIPFEVVPGVTSAVAALCYGGIPATHRDFCSSLHIITGHAREGGQLSIPFHELKELNGTIVFLMGDSSLSYLMNGLINAGMEKDMPAAIVENGTRPNQRKLVATVGTLEQKALEMEIKSPAIIAVGKVCSLSEKFSWFMKKPLFGTKILVTRPKESSGTLVEKLRQLGAEPVEYPCIEVVPIPQNEKLYHACENIREYGWILLTSKNGIQIFFDYLNSKGLDARVLANTKIGTVGSQTAKALKEVGLISDFTPEIFDGRHLALGIAERVGENEKVLICDAAIASDDIVNILRSNNIKFDRVPLYNTNYINENSNKVKKSIVHGELKYITFTSASTVEGFIASMKDIPLESLTAVCIGNKTAEAAKKYNLRYVVAEKSTIDSMIDKLLEIGGGNIYD

SEQ ID NO: 29951 - protein, 388 aa, Gossypium hirsutum
MVHCLPKVFVIQDKPILPSTAAVAKDEYWPPLAFDASILGSESNIPSQFIWPDDEKPCLDAPELVIPTIDLGAFLLRYSLAVSKAAEVVNEACKKHGFFLVVNHGVDSGLIDKAHQYMDRFFSLQLSEKQKAKRKVGESYGYASSFVGRFSSKLPWKETLSFRYCPRTQNIVQHYMVNLMGEDFRDFGRLYQEYCEAMNKVSQEIMGLLGISLGLDQAYFKDFFEQNDSILRLNHYPPCQKPELTLGTGPHTDPTSLTILHQDQVGGLQVFADEKWHSVAPYPGAFVVNVGDTFMALTKAFYKSCLHRAVVNTETVRKSLRFFLCPKLERPVTPAAGLVTAENPRKYPDFTWAALLKFTQNHYRADMKTLVAFSKWVQEQESNYKLIP

SEQ ID NO: 29952 - protein, 661 aa, Neurospora crassa
MPPPEGDSASVQAGNNSSDFVRKLYKMLEDPTYNSVVRWSADGDSFVVLENEKFTKTILPKHFKHSNFASFVRQLNKYDFHKVRHNEESGEAPYGRDAWEFRHPEFRADRKDNLDNIRRKAPAPRKPAQAEDTFGASQQIVVLSESLTATQHQIQALQEQYFELAQTNKVLVNEVISLQKMVRAQSQVSNELITHLSNIEDRRRNSRHSAHSSHSSHSGPTFHAGSLGLLPDGADEPAAELRRAREILNGVSPDSQADRELERLSVAYHQNGSPSESATSSVMFTQSGPGPMHMLHDPLNDPRHMVYPVGQTTGIDPFHSDHINNIPYTRPLSNPNAMADSAQITPPPKDQGTSMWSHKRPRILLVEDDKTCARIGAKFLHVLECSVDIAKDGLEAVEKINNPENNEGFDLIFMDIIMPNLDGVSATAMIRMVTARVPIIAMTSNIRQEDIQTYFQYGMNDVLAKPFTKDSMIRVLRKHLAYMLKDPLQGGLNADDTGQTVGAPGPPGQNQQAYSNNQQAQANMMAAAAAMANSSMGSSAQVKFEQTPIPSPATTSSWHSPGQMNQTSPNMDGGGYMNAGGNGPGGMVLTPGGTQRPPPPPYQMMNNQVNNQLAGGSAGFQGGGHIQASEGMGMGGSEENRPEKRQRLYGPGANHQRPFVQ

SEQ ID NO: 29953 - protein, 820 aa, Methylococcus capsulatus
MSKPKLVLVGNGMAGVRTLEELLKLAPGKYDITVFGAEPHPNYNRILLSPVLAGEKKLDDIILNDEDWYAGHGITLHKGKTVVAIDRGRRRVRTEDGTVADYDRLLLATGSTPFILPVPGRDLEGVVGFRDIRDVERMLEASEKHRHAVVIGGGLLGLEAANGLKKRGMNVTVAHLLDTLMERQLDKPAAALLQRALENSGLSFKLEAQTEALLGEGRVRAVRFKDGSEIPADLVVMAVGIRPNIELAKAAGIHCERGILVSDTMQTFDPQVYAVGECVQHRGELFGLVAPLFEQAKVCANHLAEFGIARYRGSVTSTKLKVTGIDLFSAGEYQGGPGFEELLFQDPSRGVYKKLVVRDNKVAGAVLYGDTVDGAWYFQMMRDGTDISAFREHILFGQAHVGDSGHGAESHAARLAEDAEVCGCNGVCKKTIVDAIIQKKLFTLDEVRAHTKASASCGSCTGLVEQLLQSTLGSDYSVSPAKKPLCRCTDLTHEEVREAVRTHGPKTIPQLMGALGWRTPDGCHTCRPALNYYLLCQWPGEYRDDPQSRFINERVHANIQKDGTYSVVPRIWGGVTNPRELRAIADVAEKFRVPCVKITGGQRIDLLGVPKARLPAIWAELGKHGLVSGHAYGKSLRTVKTCVGKEWCRFGTQDSTTLGIELEKMTWGSWTPAKVKMAVSGCPRNCAEATIKDFGVVAVDSGWELHVGGNGGVKVRATDFLCKVQTDEEVMEYAAAYLQLYREEARYLERTAHWIERVGLPYVHSRIVDDAEGRKALRARFLESQRKAQIDPWAERAQGAERHEFEPLTLRERNNHACIA

SEQ ID NO: 29954 - protein, 264 aa, Zea mays
  misc_feature (35)..(35): Xaa can be any naturally occurring amino acid
  misc_feature (110)..(110): Xaa can be any naturally occurring amino acid
  misc_feature (184)..(184): Xaa can be any naturally occurring amino acid
MPPLRRRRWAAGTTRSRCSCPELQRLLDALRASRXRGAEGGGGGGRGPGRVALVGTGPGDPELLTLKAVRAIEAADLVLYDRLVSNDVLDLVGEGSRLLYVGKTAGYHSXQEEIHELLLSFAEAGANVVRLKGGDPLVFGRGGEEMDFLQQQGIKVEIIPGITSASGIAAELGIPLTHRGVATXLMKHGLPPDTPAVAVERGTTPQQRMVFALLKDLVDEVKSADLVSPTLIIIGKVVSLSPFWVESSEHDALKIESSYASEAR

SEQ ID NO: 29955 - protein, 314 aa, Shigella flexneri
MLTSGGDAPGMNAAIRGVVRSALTEGLEVMGIYDGYLGLYEDRMVQLDRYSVSDMINRGGTFLGSARFPEFRDENIRAVAIENLKKRGIDALVVIGGDGSYMGAMRLTEMGFPCIGLPGTIDNDIKGTDYTIGFFTALSTVVEAIDRLRDTSSSHQRISVVEVMGRYCGDLTLAAAIAGGCEFVVVPEVEFSREDLVNEIKAGIAKGKKHAIVAITEHMCDVDELAHFIEKETGRETRATVLGHIQRGGSPVPYDRILASRMGAYAIDLLLAGYGGRCVGIQNEQLVHHDIIDAIENMKRPFKGDWLDCAKKLY

SEQ ID NO: 29956 - protein, 557 aa, Schizosaccharomyces pombe
MCGILAVHHVAEDIEAFKPKALHLSKQLRHRGPDWSGKAIRNQTILCHERLAIVGVESGAQPLVSDDGKLVLTVNGEIYNHLKLRENLKGNYKFKTYSDCEVILYLYREHGPACANMLDGMFSWVLYDQDKDKVVAARDPIGITTLYQGFSSDSPDTAYFASELKALHPVCDKIIAFPPGHYYDSETKQTVRYFKPSWWDENKIPSNPVDYKLLRETLEASVRKRLMAEVPYGVLLSGGLDSSLIASIAARETEKLANSTSQSEEARTITAWPKLHSFAIGLPGSPDLLAARKVADFLHTFHHEHTFTIDEGLDALRDVIYHLETYDVTTIRASTPMYLLSRKIKAQGVKMVLSGEGSDEIFGGYLYFGNAPSREAFHSECVRRVKNLHLSDCLRANKSTMAWGLEARVPFLDKDFLEVALNIDPEEKMYINGRKEKYILRKAFDTTHDSSLQPYLPQDILWRQKEQFSDGVGYSWIDALKDTAELCISDDEFALPRREWGDDIPTTKEAFWYRKLFDEIFPRQCADTVMRWVPKAEWGCPEDPSGRYQAGHVAALK

SEQ ID NO: 29957 - protein, 879 aa, Methylococcus capsulatus
MSPQFRQTVHTTCPYCGVGCGVLATVTDAGVKIQGDPDHPSNFGRLCSKGSALGETLSLGTRLLHPEIGGIRTGWDEALDTVAGRFRETLERYGPDSVAFYVSGQLLTEDYYVANKLMKGFIGSANIDTNSRLCMSSTVAGHKRAFGEDLVPGCYEDLELADLVVLVGSNTAWCHPVLFQRILAARRADPKRRIVCIDPRRTATAEAADLHLPIRPGTDVLLFNGLLHYLRHNDCLDFEFIERHTEGYAAALNMAKETAPTVPSVAAGCGLAESEVAQFYRLFAANERTVTLWSQGVNQSTQGTDKVNAILNVHLATGRIGKPGAGPFSLTGQPNAMGGREVGGLANQLAAHLDLDDPGHRRQVQEFWRSPRIADRPGYLAVDLFRAIGEGRIRAVWIMATNPAVSLPDVHAVRRALSACPFVVVSDCERDTDLSRFAHVQLPALAWGEKDGTVTNSERRISRQRAFLDAPGEARPDWWIIAEVARRMGFGAAFDYRSAADIFAEHIALSRIAGAEKRRFDLSGLQTAYDELAPTQWPVDAGNPQGTPRLSFDGRLTFVAVRPQAPAHAPDTGYPLILNTGRIRDQWHTMTRTGKTQRLTGHLPEPFAEVHPIDGSRLELTDGALARLESRYGSALVRVRFSAGQQPGTVFTPMHWSESNSRQGLVNALVNPAVDPVSGEPEFKHTPVRVVPYRPRWYGFAIARRRIEFPDAAYRVVIPARHCWRHELAGEVLSEDWQRWARERLGPEGDGWDDWLEFADPRAGRYRCAWIVQGRIEFALFVSPSHELPPRDWLVSLFGQDALSETARAGLLAGRPLSADDDRGRIVCACFAVGENTLRRTIASETLTTAEQVGTSLKAGTNCGSCLPEIHALLAEAQH

SEQ ID NO: 29958 - protein, 472 aa, Oryza sativa
AKLASHGDRLEQCCLLLLLLLCSCSSAAVAAASPAAMSSSRKAVDRLPGFAGPLPFSLETGYVAVGEARFFYYFIESERSPEEDPVLLWLTGGPGCSAFSGLIYEIGPLFFDFHGHKGGLPTLHYKANSWTKISNVIFVDSPPGTGFTYATTAEGLKSSDTIVVHQLYTFIQKWFDDHPQFSSNPLYVSGDSYSGIIIPTLTMEIAKGKESSDERHLNLKGYIAGNPLTDTTHDDNSKFPFLHSLGIIDDELYEVARKNCKGDYMTPPNSQCANSVQAIRDCIRDVNDLHILEPRCEEDGISLMSDNSASSHDRRTKLLESAVSSICRNATYVLSKIWANDEAVRESLGIHKGTVTTWERCNHDLLYKKQIVSSVEYHLSLITQGYRGLVYSGDHDSVVSLIGTQGWLRSLNLSITHGWRPWYVNSQVVGFTRTYSNNLTYATVKGAGHTAPEYMPKECLAMVDRWLSGEPL

SEQ ID NO: 29959 - protein, 719 aa, Oryza sativa
  misc_feature (505)..(505): Xaa can be any naturally occurring amino acid
MSASPSSMSGAGAGEAGVRTVVWFRRDLRVEDNPALAAAARAAGEVVPVYVWAPEEDGPYYPGRVSRWWLSQSLKHLDASLRRLGASRLVTRRSADAVVALIELVRSIGATHLFFNHLYDPLSLVRDHRVKALLTAEGIAVQSFNADLLYEPWEVVDDDGCPFTMFAPFWDRCLCMPDPAAPLLPPKRIAPGELPARRCPSDELVFEDESERGSNALLARAWSPGWQNADKALAAFLNGPLMDYSVNRKKADSASTSLLSPYLHFGELSVRKVFHQVRMKQLMWSNEGNHAGDESCVLFLRSIGLREYSRYLTFNHPCSLEKPLLAHLRFFPWVVDEVYFKVWRQGRTGYPLVDAGMRELWATGWLHDRIRVVVSSFFVKVLQLPWRWGMKYFWDTLLDADLESDALGWQYISGSLPDGRELDRIDNPQLEGYKFDPHGEYVRRWLPELARLPTEWIHHPWDAPESVLQAAGIELGSNYPLPIVELDAAKTRLQDALSEMWELEXAASRAAMENGMEEGLGDSSDVPPIAFPPELQMEVDRAPAQPTVHGPTTAGRRREDQMVPSMTSSLVRAETELSADFDNSMDSRPEVPSQVLFQPRMEREETVDGGGGGGMVGRSNGGGHQGQHQQQQHNFQTTIHRARGVAPSTSEASSNWTGREGGVVPVWSPPAASGPSDHYAADEADITSRSYLDRHPQSHTLMNWSQLSQSLTTGWEVEN

SEQ ID NO: 29960 - protein, 448 aa, Oryza sativa
  misc_feature (195)..(195): Xaa can be any naturally occurring amino acid
MALLQFGGTLAPKLGEKPQLLPRSPALTRVIYADPRFLVSKSGSGGRLKHLVSPTASLQSRTSSRLFNHAPSPRFRHRRSSRFIVRADADFYSTLGVSRNASKSEIKSAYRKLARSYHPDVNKDPGAEQKFKDISNAYEVLSDDEKRSIYDKYGEAGLKGAGMGTGDYSNPFDLFESLFEGFGGMGGMGGRAARXNRPMQGDDEAYNLVLNFKEAVLGVEKEIEITRLEGCNTCDGTGAKPGTKPTTCKTCGGQGQVVSSTRTPLGIFQQVSTCNTCGGTGEFSTPCNTCGGDGRVRKTKRISLKVPAGVDSGSRLRVRSEGNAGRRGGPPGDLYVFIDVLSDPVLKRDGTNILYTCKVSYIDAILGTTVKVPTVDGMVDLKIPSGTQPGTTLVMSKKGVPLLGKSNARGDQLVRVQVEIPKRLSSDERKLIEELANLNKAQTANSRR

SEQ ID NO: 29961 - protein, 478 aa, Myxococcus xanthus
MNRTTRTMRLFPLLAAVSLAAAGCTSSKATGPSTKTADPNAGKTEALQPISNTAKARFEDALKAFDTQKKAKAIDYPSLERKFQSALEADGNLAEADYNLGVLAERQGKLTEARNHYKTALTKKPSLRQASENLAVMEQNAGNVAGAVALYQEVLQRYPDDAQSRARLAEIFRQQGDHTKAMDLTRAALMRDPQSTTALKVMIRSYLDRKQLAMAKLVALRGVKLDAADPELHHAVGLILLQEGDVDDARLSFKKALEVREDYVPSHVELAQLALAAENYPTAEQHLRRILQADGKNAAAHLDLGVAYKGMGQFDKAMQEYDEAEKLDPELAAVNLNRAIILHKVKDAPERASELYRKYIAMAGGEVALPAEAPVFALLREVEVVVNAKREAKFAEEQAKQMEELQKQQQAQMQAAEKAAGTANPPATTATPASGTGPAPQVTPASGNTPPAPAPVNGNSDQKNAGSAEPGEPEDDLL

SEQ ID NO: 29962 - protein, 485 aa, Bacillus halodurans
MNKQGKVYLVGAGPGDLRLMTLKGKDCLQKADVVLYDRLVNPLFLEWTKPEAELIYCGKLPDRHLLRQEAINELLIEKGRQGKVVVRLKGGDPSVFGRVGEEADVLKEAGLPYEIVPGITAGIGASTYAGVPVTHRDYGASFTVVTGHDKSPSGQPLIDWHALANGIDTIAFYMGVSNLPYITEQLIAHGRDPETCVLLIQWGTIGKQRVVEGRLNTIVSRVKEEGITNPAITLVGNIGKLRTEKSWFESQRLFGHQVLIGRTTAEEGGLAKTLMEAGAEVFEFPRWHVTSKPWEVTPGEVQEADHLVFTSPHSVHFFFESLTEQRMDIRHIRGSFFAASKKSLKIIRSFACTAALLQELPAGGKTIIFGDEENEMKQKYPFEEASYVSTHQKTLVPQSLRTCRRLLDEGRIETLVFPSAASVNAVIDGLEKCGESVGTLSQVKTVITFGPESSNAAKEAGFQVDIQLEAPSAQLLIETLEAVRV

SEQ ID NO: 29963 - protein, 321 aa, Haemophilus somnus
MIKKIAVLTSGGDAPGMNAAIRGVVRSALSEGLEVYGIYEGYYGLYHNKIQQLTRYSVSDIINRGGTFLGSARFPEFKDPAVREKCVEILRSHGIDALVVIGGDGSYMGAKLLTEEHDFPCVGIPGTIDNDVAGTDYTIGYQTALETAVEAIDRLRDTSSSHKRISIVEIMGRHCSDLTISAAIAGGCEYIVASEIEFNREELIKQIERAIIKGKRHAIIAITELLCDVNELAREIEARVKHETRATILGHIQRGGTPCAFDRILGSRMGVYAVDLLLQGKGGYCVGIQNEQLVHHDIIDAINNMRREFKADWLAMSKRLD

SEQ ID NO: 29964 - protein, 424 aa, Aspergillus oryzae
MIARQLCMRQSRQLHAFNRQARTLNSLNRFYSTEPPVDTTLQTRIKERSAEIESRYQNDAVPERISRRRAEQLAWKARGERKFKFQDLGSSVTDAYKPEDIIRNPPKPSDVTLELLLASQTHLGHSTSRWNPQNSRYIFGIRDGIHVISLDVTAAYLRRAAKVVEEVAARGGLILFVGTRKGQKRYVVRAAELAKGYHIFERWIPGSLTNGQQILGHCETKVVNAMDEEIPKYREALADRSVLKPDLVVCLNPLENVVLLHECGLNNVPTIGVIDTDADPTRVTYPIPSNDDSMRAIGVIAGVLGRAGEAGQQRRLENAKNGVLTYPPITPEHLLSPERLAELAQIEAGNVAANAEAAEIANKLDEAVQSIETEQASTPQETSQSTESQPEPQTQVPETEKPAEPQPEQPQTQAQAPETPVKDQ

SEQ ID NO: 29965 - protein, 258 aa, Picea glauca
MEDMNMNIGGAATFYGVNMNEYGDTGVGSMMALMTEQEPGNESIMSTMTMTIPSSAFSSYSHAGQVEGLLSAAAATMFNQGGHHHHQKHLVGGHFPPEQLVMNEQAAVISDSSLSSVKTEVCSNQLEFHRKTSGGGRSCCPQPSLVVRAPQQQQHHHQEASRMVTSLEVDIDSACSSNPNDSIDTLKTKIACHPHYPQLLAAYMDCQKIGAPPEVVTVLDEISQENQLGRHLATMDIGVDPELDQFMEAYCQMLIKYH

SEQ ID NO: 29966 - protein, 338 aa, Pediococcus pentosaceus
MVKKVAVLGAGSWGSILANMLVQNGNDVVAWTNMEEQAKELNEQHSNEHYVPGFKYDERLVATTDLEVALKDVDAVLFVVPTKVMRLVAQQMVEVLKKTGQKPIIVHASKGLELGTHKRLSEVLAEEIPSELRQAIVVLSGPSHAEEVAKQDLTLVTAASSDLASAEAVQKLFMNNYFRVYTNDDIVGVEMGAALKNVIAIGAGALHGLGYGDDAKAALITRGLAEISRLGVAFGANPLTFIGLSGVGDLIVTATSVHSRNWRAGNELGQGMKLDEVIDTMGMVIEGVPSTKAAYELAQQKNIEMPITEAIYDVLYNEKGVKEAIDELMHRDGRSELE

SEQ ID NO: 29967 - protein, 308 aa, Pediococcus pentosaceus
MTKQYDVVIIGAGPAGMTAALYASRANLSVVMLDRGIYGGQMNNTADIENFPGFKSVLGPDLSKDMYESSTQFGAEYAYGSVESIRDDGATKLVKTDMGDEFEAKVVIIGTGSEYKKLGVPGEEDFSGRGVSYCAVCDGAFFKGTDVVVVGGGDSAIEEGLYLTQLASKVTVIHRRDQLRAQKIIQDRAFANPKMEFVWNSNVTEVVGEGKVTGVKVNNNQTGEDSFIEAAGIFIYVGVKPMTAAFADLGILDEQGWIPTDDHMHTKVPGILAVGDVRKKDLRQITTAVGDGGVAGQQAYEYIQALND

SEQ ID NO: 29968 - protein, 400 aa, Lactobacillus johnsonii
MTDNSNQFLDALKEMQGVEVGNIVNVEVLSVEDGQIAVGVENAGVEGVITKREFTNDRNADLNQLVKPGDKFEALVLRRAGGDKENGEFFFSVTRLKEREAYKELEKVFEEGKTVEGTVTGAVRGGLLVDVGTRGFLPASLISNRYVSDLKPYIGKKMNLKITEIDPNKNRLILSRKDLIEQEREEAFENVASQLVVGDTVEGKVSRLTGFGAFVDVGGVDGLVHISEISYKHVDKPSDVLKAGQDVKVKVIGIDDDRHRISLSIKQTLPSPFEEATEGLHEGDIIEGEVKTLTSFGAFIEVADGIQGLVHVSEIANKHVDKPSDVLKVGQTVKVKVLSVDPSDRRISLSIKQADPNAAKSENNSRPRRRQDSVADKYMNDNDNGFALGDIIGDQLKDKD

SEQ ID NO: 29969 - protein, 314 aa, Arabidopsis thaliana
MYLLVFKLFLFLSLLQISVSARNLASQEPNQFQLLKYHKGALLSGKISVNLIWYGKFKPSQRAIISDFITSLTHTSPTSKTLHQPSVATWWKTTEKYYKLATPSKNSSPLSLTLGKQIIDESCSLGKSLTDKKIQTLASKGDQRNAINVVLTSADVTVTGFGMSRCGTHGHARGLGKRGSKFAYIWVGNSETQCPGQCAWPFHAPVYGPQSPPLVAPNNDVGLDGMVINLASLLAGTATNPFGNGYYQGPQNAPLEAASACPGVYGKGAYPGYAGDLLVDTTTGGSFNAYGANGRKFLLPALYDPTTSACSTMV

SEQ ID NO: 29970 - protein, 101 aa, Vigna radiata
WLTGAPGCSSELALFYENGPFQLTKNLSLVWNDYGWDKASNIIFVDQPTGTGFSYTSDESDIRHDEEGVSNDLYDFLQAFFKEHPQFTKNDFYITGESYAG

SEQ ID NO: 29971 - protein, 112 aa, Unknown
  Mesorhizobium sp. BNC1
MKKIEAIIKPFKLDEVKEALQEVGLQGITVTEAKGFGRQKGHTELYRGAEYVVDFLPKVKIEVVLIDEMVDAAIEAIRKAAQTGRIGDGKIFVSNVEEVIRIRTGETGPDAV

SEQ ID NO: 29972 - protein, 523 aa, Zea mays
  misc_feature (471)..(471): Xaa can be any naturally occurring amino acid
RPWDCGAGSISLGHKVLCRFGVPNSSRLRWVGYDRKPRTDQLIARAVSVDRTQLDFSNPDWKKQFQEDFDKRFSLPHLTDVIDVEPRPTTFSLKSRAPLENANGTMQGSWNGYVNDDDRALLKVIKFASPTSAGADCIDPDCSWVEQWVHRAGPRKQIYFEPQYVKAGIVSCGGLCPGLNDVIRQIVLTLEKYGVKNIVGIQHGFRGFFEDHLSEVPLSRHVVQNINLAGGSFLGVSRGGANISDIVDSIQARRLDMLFVLGGNGTHAGANAIHDECRKRKLQVSIVCVPKTIDNDILLMDKTFGFDTAVEAAQRAINSAYIEAHSAFHGIGLVKLMGRSSGFITMHASLSSGQVDICLIPEVPFTLDGPNGVLRHLEHLIETKGFALVCVAEGAGQEYFQKSNATDASGNMVLSDIGVHLQQKIKSHFKDIGVHSDVKYIDPTYMLRAVRANASDAILCTVLGQNAVHGXAFAGFSGITTGVCNTHNVYLPIPEVIKSTRFIDPNSRMWHRCLTSTGQPDFH

SEQ ID NO: 29973 - protein, 568 aa, Unknown
  Synechococcus sp. CC9311
MTPSVVTYALDRLADLGIGHVFGVPGDYSFPINDAVEVHPRLRWVPSANELNAAYAADGYARRRGAAIVCTTYGVGELSALNGLMGAMAERLPVFHLVGTPSLRIVRQGLICHHTLGDRNYDRFEAISASASCVSARLTPENAVIELERVIDKALEQSRPAYLTFPMDLALMPITGTPIQGSPLGVIDQHDSVSAELEAVLDLLESRIASASRPVVLPTITLKRFGLVNAFEEFLKASGLAYATTPMDKALLSEQHPAFLGMYNGGRSTPAALQSVVEEADLVVDIGGLVLEDLNTGLWSGSLDPNRIVALHADWVQAGHQVFTSVSISDVLAGLTRRFQTSSKRLSYWGEHRPVRPAPMLPLLGEPDQPTDSASFYPRLQQFLRPNDLLLSDTGTCLLKLNAIRLPDGVTMESQTLWGSIGWGTPAALGCALAEPERRVVLVTGDGAHQLTVQEIGVMGFTGVNPVVIVLNNGLHGIEALISETGHAYNDLPPWHYANIPAALGCKDWWSGRAATVAELEQALAAISAHQGAAYLEVVIPAEESQPLAEEVIEIFHQTTTPKSALTD

SEQ ID NO: 29974 - protein, 506 aa, Oryza sativa
MGKGTVVGTAVVVCAAAAAAVGVAVVVSRRRRSKREAEEERRRRAAAVIEEVEQRFSTPTALLRGIADAMVEEMERGLRADPHAPLKMLISYVDNLPTGDEHGLFYALDLGGTNFRVIRVQLGGREKRVVSQQYEEVAIPPHLMVGTSMELFDFIAAELESFVKTEGEDFHLPEGRQRELGFTFSFPVHQTSISSGTLIKWTKGFSINGTVGEDVVAELSRAMERQGLDMKVTALVNDTVGTLAGGRYVDNDVAAAVILGTGTNAAYVEHANAIPKWTGLLPRSGNMVINMEWGNFKSERLPRSDYDNALDFESLNPGEQIYEKMISGMYLGEIVRRILLKLAHDASLFGDVVPTKLEQRFILRTPDMSAMHHDTSHDLKHLGAKLKDILGVADTSLEARYITLHVCDLVAERGARLAAAGIYGILKKLGRDRVPSDGSQKQRTVIALDGGLYEHYKKFRTCLEATLADLLGEEAASSVVVKLANDGSGIGAALLAASHSQYASVE

SEQ ID NO: 29975 - protein, 852 aa, Streptococcus thermophilus
MNMTEKIQTYLNDPKIVSVNTVDAHSDHKYFESLEEFSEGEMKLRQSLNGKWKIHYAQNTNQVLKDFYKTEFDETDLNFINVPGHLELQGFGSPQYVNTQYPWDGKEFLRPPQVPQESNAVASYVKHFTLNDALKDKKVFISFQGVATSIFVWVNGNFVGYSEDSFTPSEFEISDYLVEGDNKLAVAVYRYSTASWLEDQDFWRLYGIFRDVYLYAIPKVHVQDLFVKGDYDYQTKAGQLDIDLKTVGDYEDKKIKYVLSDYEGIVTEGDASVNGDGELSVSLENLKIKPWSAESPKLYDLILHVLDDDQVVEVVPVKVGFRRFEIKDKLMLLNGKRIVFKGVNRHEFNARTGRCITEEDMLWDIKVMKQHNINAVRTSHYPNQTRWYELCDEYGLYVIDEANLETHGTWQKLGLCEPSWNIPASEPEWLPACLDRANNMFQRDKNHASVIIWSCGNESYAGKDIADMADYFRSVDNTRPVHYEGVAWCREFDYITDIESRMYAKPADIEEYLTTGKLVDLSSVSDKHFASGNLTNKPQKPYISCEYMHTMGNSGGGLQLYTDLEKYPEYQGGFIWDFIDQAIYKTLPNGSEFLSYGGDWHDRPSDYEFCGNGIVFADRTLTPKLQTVKHLYSNIKIAVDEKSVTIKNDNLFEDLSAYTFLARVYEDGRKVSESEYHFDVKPGEEATFPVNFVVEASNSEQIYEVACVLREATEWAPKGHEIVRGQYVVEKISTETPVKAPLNVVEGDFNIGIQGQNFSILLSRAQNTLVSAKYNGVEFIEKGPKLSFTRAYTDNDRGAGYPFEMAGWKVAGNYSKVTDTQIQIEDDSVKVTYVHELPGLSDVEVKVTYQVD

SEQ ID NO: 29976 - protein, 499 aa, Glycyrrhiza echinata
MDILSLLSYSVFYLALFFIFNIVIRARKFKNLPPGPPSLPIIGNLHHLKRPLHRTFKGLSEKYGHVISLWFGSRLVVVVSSASEFQQCFTKNDVVLANRPRFLSGKYIFYNYTTLGSTSYGEHWRNLRRITALDVLSNHRINSFSGIRRDETQRLITRLADDSSTNFAEIELSYRFYDMTFNNIMRMISGKRYYGEDCDMSDLQEASQFRDMVSELLQLSGANNKTDFMPLLRFLDFENLEKRLKDISGKTDAFLRGLIQEHRAKKERANTMIDHLLNLQDSQPEYYTDQIIKGLALAMLLAGTDSSAVTLEWSMSNLLNHPEVLKKVKDELDTHVGQDRLVDESDLPKLSYLKNVINETLRLYTPAPLLLPHSTSDECNIGGYKVPQDTIVLINAWAIHRDPELWTEATTFKPERFEKKGELEKLIAFGMGRRACPGEGLAIRAISMTLALLIQCFDWKLTNGDKIDMAERDGFTLTKLVPLKAMCKSRPVINKVFKQ

SEQ ID NO: 29977 - protein, 441 aa, Sorghum bicolor
MAVRACLRRFGEREMERHDRLRALMVRLEADGQVDRLLRAQEDDHAARTGEEKQIQYPFFPKGTQELLKARVDIAQYSLPCAKARIEMAKRCHEDSDEDLKAEAELVVKLAEEFVLECSEIGDDRPLIGCSFSCDASMLATSKVFEQRLTQGPIAGESQGKGTSAVSMHAQIHMVVRAEPDPRYVFQFDGKPEYGSVMYHVPGGAASGGQRRQPVFTPLRPCCAAWILVPCRDLEPRPTAVALSGQPPGRRHWKIQSRDGSGGDAALAWSPLRSPVARPHLGSSIDSYSNTTLWSINLFILDKDTRTIYILDPNPLDPTYQYNPDGRYVKKLLWIAEYLPKAMSTVCPRSKWNENVFLWWQRILYDIPVYKRELSGYVVSIFVSSWKGEELNLPFLMDEYELTKQMLGQLLTYKDKECEDNMPAGVLEISLEIFKVHVKSA

SEQ ID NO: 29978 - protein, 77 aa, Antirrhinum majus
MKEQKWIHEGLITESLPNGMFRVRLDNEDLILGYVSGKIRRSFIRILPGDKVKIEVSRYDSTRGRIIYRLRNKDSKD

SEQ ID NO: 29979 - protein, 425 aa, Coffea canephora
MPMTMILPPSSREMMGLGLGCSPSSKTLAFRHPNTLPNYINCSLQTPSILHFPKQSSATTSSPPSSSSAKTAYPALFLPGSSAAIATPSKTPTGTATVPTPSPSISASPSPSRSPSTTPQWNVLQRAAAMALDAVETALTARELEQPLPKTADPRIQISGNFAPVPEQPVRHALPVTGKIPNSIQGVYVRNGANPLFEPAAGHHFFDGDGMIHALQFQNGSASYACRFTETQRLAQERSLGRPVFPKAIGELHGHSGIARLMLFYARGVFGLLDHSQGTGVANAGLVYFNNRLLAMSEDDLPYHVRITPSGDLKTVERYSFNGQLKSTMIAHPKLDPVTGELFALSYDVIQKPYLKYFRFSKAGEKSKDIEIPVPEPTMMHDFAITDNFVVIPDQQVVFKMSEMIRGGSPVVYDKEKVSRFGVLD

SEQ ID NO: 29980 - protein, 527 aa, Oryza sativa
MAVTRLAVAAALSAAPPSSRRRRAFFHHSCRPLPSSAVAAKALRASAAPAVDEEAPASPPPSDLGKGVENLVIIGSGPAGYTAAIYAARANLKPVVFEGYQVGGVPGGQLMTTTEVENFPGFPDGVTGPDLMDKMRKQAERWGAELHQEDVEFVNVKSRPFVIRSSDRECTELLWTNVFAALIPRLRLPREDEFWSRGISACAICDGASPLFKGQVLAVVGGGDTATEEAIYLTKYARHVHLLVRKDQLRASKAMQDRMLACLQLHEILMRVLSNPNITVHFNTEAVDVVSNPKGQMSGIQLKRTDTGEESVLEVKGLFYGIGHTPNSQLLQGQIDLDDAGYILVEEGTAKTSVDGVFAAGDVQDHEWRQAVTAAGSGCVAALSVERYLVANDLLVEFHQPVREEKEKEITDRDVEMGFDISHTKHRGQYALRKVYHESPRLVCVLYTSPTCGPCRTLKPILSKVIDEYNEHVHFVEIDIEEDPEIAEAAGIMGTPCVQFFKNKEMLRTVSGVKMKKEYREFIESNK

SEQ ID NO: 29981 - protein, 491 aa, Zea mays
MALTRIGLAGLAVMGQNLALNIAEKGFPISVYNRTTSKVDETVQRAKVEGNLPVFGFHDPASFVSSIQKPRVVIMLVKAGAPVDQTIATLAAHLDQGDCIVDGGNEWYENTERREKAMEERGLLYLGMGVSGGEEGARNGPSLMPGGSFEAYKYIEDILLKVAAQVPDSGPCVTYIGKGGSGNFVKMVHNGIEYGDMQLIAEAYDVLKSVGKLTNSELHQVFSEWNKGELLSFLIEITADIFGIKDDKGEGYLVDKVLDKTGMKGTGKWTVQQAAELSVAAPTIEASLDSRFLSGLKDERVEASKIFQGDYSTGLPVDKAQLIEDVRQALYASKICSYAQGMNIIKAKSSEKGWGLNLGELARIWKGGCIIRAIFLDRIKKAYDRNPNLANLLVDPEFAQEIIDRQAAWRRVVCLAINNGVSTPGMSASLAYFDSYRRDRLPANLVQAQRDYFGAHTYERRLLRRSHVTKRFDMPGSFHTEWFKIARNSKI

SEQ ID NO: 29982 - protein, 175 aa, Zea mays
  misc_feature (5)..(5): Xaa can be any naturally occurring amino acid
  misc_feature (7)..(7): Xaa can be any naturally occurring amino acid
  misc_feature (15)..(15): Xaa can be any naturally occurring amino acid
DSSDXIXPAQELVEXPFFETIARALRPGGVLCNQAESMWLHTHLIQDMLSICRETFKGSVRYAWASVPTYPRTSHSLTNHYGVIGFLLCAKDGPPVNFLTPVNPIEEVEGATKAGREIRFYNSEMHMAAFVLPTFAKRELEAYCASTETEQAEEVAATAPQKLTAAPKRGITTAS

SEQ ID NO: 29983 - protein, 339 aa, Lactococcus lactis
MSNQEPIANYKFNYKTTANKVMKNINLSGKTIIITGGYSGIGLEMTKQLSRAGAKIIIPARRMEVAKKNLSKIKNIDILPLDLTNPESIHQFAESFLQNNSKLDILINSAGLMYLPLKRDSRGIEYHFATNHLGHYQLTLELLPALKNAKISRVINLSSRAQQMTPLLEDWNFEKIENYNPQIGYQQSKTANVLFSIKLDELGKKYGIRSFAVHPGMIPMTNIGRQNSPITPWLRYLADYFKLIHIPVFFNALKSGFDRSKYRYLKTIAQGAATPLWASTSPDLEGKGGLYCEDLNIARLMTSEEANNFSGGLRPHAIDHNDADRLWQISKNITGLDFE

SEQ ID NO: 29984 - protein, 377 aa, Brucella melitensis
MKIDYYEALGVTRTADDKTLKAAFRKLAMQYHPDRNPDDPEAERKFKEIGEAYETLKDPQKRAAYDRFGHAAFENGGMGGGFGNGFGGAGGFADIFEDIFGEMMGGGRRRSNGGRERGADLRYNMEVTLEEAYAGKTAQIRVPTSITCDECSGSGAKPGSQPTTCTMCSGSGRVRAAQGFFSVERTCPGCNGRGQIIKDPCEKCHGQGRVTQERSLSVNIPAGIEDGTRIRLAGEGEAGLRGGPAGDLYIFLSVKPHEFFQRDGADLYCKVPISMTTAALGGQFEVSTLDGTQTRVKVPEGTQNGKQFRLKGKGMPVLRQSVTGDLYIQIDIETPQNLSKRQRELLEEFEKLSSQENSPKSAGFFSRMKEFFEGIGE

SEQ ID NO: 29985 - protein, 701 aa, Pseudomonas putida
MNPVIKTFQFGQSTVTLETGRIARQATGAVLVTVDNDVTVLVTVVGAKQADPGKGFFPLSVHYQEKTYAAGKIPGGFFKREGRPSEKETLTSRLIDRPIRPLFPEGFMNEVQVVCTVVSTSKKTDPDIAAMIGTSAALAISGIPFEGPIGAARVAFHESTGYLLNPTYEQLAASSLDMVVAGTADAVLMVESEAQELTEDQMLGAVLFAHDEFQAVIQAVKELAAEAAKPTWDWKPAVANTELFNAIRAEFGEAVSQGYTITVKADRYARLGELRDQAIAKFSGEEGQPSASEVKEIFGEIEYRTVRENIVNGKPRIDGRDTKTVRPLNIEVGVLPKTHGSALFTRGETQALVVATLGTARDAQLLDTLEGEKKDPFMLHYNFPPFSVGECGRMGGAGRREIGHGRLARRSVQAMLPAADVFPYTIRVVSEITESNGSSSMASVCGASLALMDAGVPMKAPVAGIAMGLVKEGEKFAVLTDILGDEDHLGDMDFKVAGTAKGVTALQMDIKINGITEEIMEIALGQALEARLNILGQMNQIIGQSRTELSANAPTMIAMKIDTDKIRDVIGKGGATIRAICEETKASIDIEDDGSIKIFGETKEAAEAAKQRILGITAEAEIGKIYVGKVERIVDFGAFVNILPGKDGLVHISMLSDARVEKVTDILKEGQEVEVLVLDVDNRGRIKLSIKDVAAAKASGV

SEQ ID NO: 29986 - protein, 494 aa, Salmonella typhimurium
MHIKYLWMCDCGGKKSQGVKWLPFILILVIAAGLWQLTPPSGLSAPAWHSAIIFVATIASIVAKVLPIGAVGIIGITVFALAYAAGDKTASGAITTALSELNSSLIWLIVVAFMIARGFIKTGLGRRIALQMIRLLGKRTLGLAYGLAFADLILSPAMPSNTARCGGVIYPIADSLARSFDSHPEDESRSKIGTFLITCIGNVNDVTAALFMTGYTGNLLAVKLAANAGVTLSWGSWFIAALLPCLVSFLIVPLLVYWLTRPEIKHTPDAPDLARKELAQMGSMTRGEWLMLATVGVLLVLWIFGSSLGVDATTASFVGLSILLLSGVLTWEDVKSEKGAWDTLIWFAALLMMANQLKKLGFTSWFGNLIGDSIGSTMHGTSWIIILLLLNAAYFYTHYFFASGNAQIAALYAVFLGVGLHLNIPAAPMALMLAFTSSLYCSLTQYTHARGPILFGAGYVPTGVWWRTGFIISLFNQAVFLTVGLAWWKVLGLY

SEQ ID NO: 29987 - protein, 327 aa, Aspergillus oryzae
MSPPAAIYEPTVAATGLKGKVVVSETAPVEGASQTKLLDHFGGKWDEFKFAPIRESQVSRAMTRRYFEDLDKYAESDVVIVGAGSCGLSTAYVLAKARPDLKIAIVEASVSPGGGAWLGGQLFSAMVMRRPAEVFLNELGVPYEEDANPNYVVVKHASLFTSTLMSKVLSFPNVKLFNATAVEDLITRPTENGNPQIAGVVVNWTLVTLHHDDHSCMDPNTINAPVIISTTGHDGPFGAFCAKRLVSMGSVDKLGGMRGLDMNSAEDAIVKNTREVTKGLIIGGMELSEIDGFNRMGPTFGAMVLSGVKAAEEALKVFDERQRECAE

SEQ ID NO: 29988 - protein, 111 aa, Taraxacum officinale
KKRGHAHGNRSWIKIEENGNSKVVELDKASVMRQCCLPARDLRLLDPLFIYPSTILGREKAIVVSLEQIRCIITADEVFLMNSLDASVVQYKSELCKRLQEEKCHSDDLPF

SEQ ID NO: 29989 - protein, 416 aa, Bacillus halodurans [sequence omitted]

SEQ ID NO: 29990 - protein, 566 aa, Oryza sativa
  misc_feature (190)..(190): Xaa can be any naturally occurring amino acid
MEAGAADEETPLIQQLPPEEQCSQYTCDGTVNSDKKPALKQSTGHWRACFFILGAQFAETLCFFMVSKNLVMYLTSALHESNIDAAQSVSIWIGTSFFTPLIGAFLADTYWGRYWTTVISLFIIIIGMLIVTVSSSPLFLNSSYYNWNICRATVYTGLYLTAVGSGCMKPCIPAFGADQFDSADPVERLXKGSFFNWDYFSMNVGSLLSTTLLVWVVANIGWSVGFAIPMLLSGFGLALFFAGRKVYRYKKQGGSPLTRVSQVVVAAVRNHRLKLPDDSSLLHEVSKVTEDDYRTQLTTQFRFFDKAAILSDEISPAQWSPWRLCTVSQVEELKILLRMFPVWVSMVVFFVVTAQITSTLIEQGMAMDGRVGPFTLPAASIATFDVISVLVWVPVYDTVLVPLARRVTGKDRGISHLQRIGVGLALAAVAMAYSAVVEARRLGTAPAPVSIMWQAPSYLVLGVAEAFSVIGMMEFFYEQSPESMKSLCTALGQLAIAVANYLNSGVLVVVAAATTRGGGAGWIPDNLDEGHLDYFFWMMAVVSVLNLLHFLHCSIRYRANNTSLWS

SEQ ID NO: 29991 - protein, 188 aa, Triticum aestivum
LSFHMGSRVFLVAAVLAMAVAAAGADVAADRAECSDKLVALATCLTFVQGQGQAPTPDCCGGLKTVLQTSPKCLCVLVKDRDDPGLDLKLNVTRALGLPAACSAPANISDCPRLLNLPPNSKDAEVFEQFAKQQAAQSSPSGASSAPSTGAQKNAAARMRWLGVGGVGVAARAAPLLFFAVPFLLLLR

SEQ ID NO: 29992 - protein, 514 aa, Sulfurospirillum deleyianum
MKFKLLLAGSLVAVGAMALLASNINEKEKQRVELAKAPSEAGIAGKEKSEEWAKYYPRQFDSWKKTKEYDSFTDMLAKDPALVIAWSGYAFSKDYNSPRGHYYALQDNVNSLRTGAPVDAKTGPLPTACWTCKSPDVPRLIEEDGELEYFTGKWAKYGSQIVNVIGCANCHDDKTAELKVRVPHLNRGLQAAGLKTFEESTHQDKRTLVCAQCHVEYYFKKTEWKDAKGADKTAMVVTLPWANGVGKDGNAGVEGMIKYYDEINFSDWTHNISKTPMLKAQHPGFEFWKSGIHGQKGVSCADCHMPYTQEGSVKYSDHQVKENPLDSMDQSCMNCHRESESKLRGIVHQKYERKEFLNKVAFDNIGKAHLETGKAIEAGASDEELKEVRKLIRHGQFKADMAIAAHGNYFHAPEETLRLLAAGSDDAQKARLLLVKILAKHGVMDYIAPDFDTKDKAQKLAKVDIAALAAEKMKFKQTLEQEWKKEAKAKGRANPELYKDVDTINDGKSSWNKK

SEQ ID NO: 29993 - protein, 355 aa, Yersinia pseudotuberculosis
MSQKFLFIDRDGTIIAEPPTDYQVDRLDKLALEPDVIPALLALQKADYKLVMITNQDGLGTSSFPQETFDPPHNLMMQILTSQGINFEQILICPHLPEDNCTCRKPKTALVESYLADGVMNSATSYVIGDRETDLQLAENMGISGLRYQRDGLNWTQIAKQLTQRDRHAYVNRVTKETAIDVNVWLDREGGSKIKTGVGFFDHMLDQIATHGGFRMDIQVSGDLYIDDHHTVEDTALALGEAINIALGDKRGIGRFGFVLPMDECLARCALDISGRPHLEYKAEFNYQRVGDLSTEMVEHFFRSLSYAMACTLHLKTKGRNDHHRVESLFKVFGRTLRQAIRVEGNTLPSSKGVL

SEQ ID NO: 29994 - protein, 709 aa, Nostoc punctiforme
MYVAVWPGNVYPLGANWDGKGTNFALFSENATGVELCLFDADNHEIRLPLTEKNNFVWHAYLPGVGPGQRYGFRVHGPWAPELGHRFNPNKLLIDPYAKAIDGEISDTAAIFGYSLDAPEQDLAFSDLDNAEIMPKCIVVDQSFDWGDDKLLSIPWHETIIYETHVRGFTKLHPEIPEELRGTYAGLAHPVAIQYLQQLGITSVELMPVHHFLSSPGFLVNKGLKNYWGYDSINYFTPYSGYSANGSVGQQVTEFKQMVKDLHSAGIEVILDVVYNHTGEGNHLGPTLSLRGIDNAVYYRLVKDNSRYYMDFTGCGNSLNVRHAQVLKLIMDSLRYWVTEMHIDGFRFDLASALARELYEVDSLAAFFDIIHQDPVLADVKLIAEPWDLGEGGYQVGNFPLRWSEWNGRYRDTVRDFWRGEDDSLGQFAYCFTGSPDLYQANGRNPSASINFITAHDGFTLNDLVSYNEKHNQDNGEDSRDGESHNRSWNCGVEGETNDPDVIRLRQRQRRNFLATLMLSQGIPMLLGGDEIGCTQKGNNNVYCQDNEIAWRDWSLQKSNSELLDFARELIYFRHQHPVFRRRKWFQGRPIHGFGISDIGWFNDDGSEMTEKQWLVSYAKAMEIFLNGEGIVTPGRRGERIIDESFLLFFNAHYETIEFALPNVFQDREWEIVIDTNEPRFLSPGKLVMGEQTVPVTDRSLIVLRRLAS

SEQ ID NO: 29995 - protein, 474 aa, Streptomyces coelicolor
MTAPRTPRKAFGRLSLPERTYLADALRTETVGGVLLLVAAIAALVWANIPALHDSYESVSHFHFGPAALGLNLSVAHWAADGLLAIFFFVAGIELKRELVAGDLKDPKAAALPVVAALCGMVVPAVVYTVTSTAGGGSLSGWAVPTATDIAFALAVLAVIGTSLPSALRAFLLTLAVVDDLFAILIIAVFFTETLNFAALGGAVVGLAVFWLLLRKGVRGWYVYVPLGLVIWALMYNSGVHATIAGVAMGLMLRCHRREGEDHSPGEHIEHLVRPLSAGLAVPLFALFSAGVAITGGALADVFTKPETLGVVLGLVVGKTLGIFGGTWLTSRFTRASLSDDLQWADVFAVATLAGIGFTVSLLIGELAFEDDAAMTSEVKAAVLTGSLIAAALATVLLKIRNAKYRGMVAEEERDDDLSGVPDIYEEDDPAYHLRVAAIYEKKAAEHRRIAEEMESARLAEVAGGAGDEGDGPA

SEQ ID NO: 29996 - protein, 598 aa, Unknown
  Frankia sp. EAN1pec
MLRPRDTATRERRNLSGLWAFRLDPAGVGREAGWWQGRLPEAREMPVPASYNDVLVDAGVRDHIGDAWYQTTVRVPRGWAGQRVVLRFDSATHRAVVWVDDVEVASHEGGYTPFEADITAYARPGREIRVTAVVNNELTWQSVPPGVVEDTPSGRRQNYFHDFFNYAGLHRPVWLYCTSPDHIDDITVVTGLDGAVGTVDYRVEVAGAGEAAGDAVRQIRAVLEDAEGAEVARSTGASGVLTVEGVRPWQPGAGYLYTLRVELADGGELVDDYTLAVGIRTVEIDGTNFLINGEPFYFTGFGKHEDLPIRGKGHDDVFLVHDFALMEWIGANSFRTSHYPYAEEVLDHADRHGIVVIDETAAVGQNTGVGGGIVGSRPYPTFSPETINDASRDVHAQAIRELVARDKNHPCVVLWSVANEPESTTEASRDYFEPLFALTRELDPTRPVGFVNMLLARPGMDLVMQFSDVIMLNRYYGWYLNTGDLAGAETAWQAELEGWAAEGKPIIITEYGADTITGLHQVTPQPWSEEYQAEYLEMNHRVFDRIDAVIGEHVWNFADFATKSAIFRVDGNKKGVFTRDRHPKSAAHTLRRRWRGKN

SEQ ID NO: 29997 - protein, 615 aa, Oryza sativa
MASISGAAAAAPSSSGASCGLRLRRDHLPRSSHFRLARPSSITDVSRSCSSSSSSPPRSLSSKQSGHADVLAHGAVDKDPIRLWNRYVEWLYQHKQLGLFVDVSRIGFTEEFLRRMEAPMGRAFAAMRELEKGAIANPDEGRMVGHYWLRNPALAPNSFLRDKIETTLERILAFASDVISAKIRPPSSPAGRFTQILSIGIGGSSLGPQFVAEALAPDNPPLMIRFIDNTDPAGIDHQIAQLGPELASTLVIVISKSGGTPETRNGLLEVQKAFRDAGLEFSKQGVAITQENSLLDNTARIEGWLARFPMFDWVGGRTSEMSAVGLLPAALQGIDIKEMLVGAAQMDEETRNTEIKENPAALLALCWYWASDGIGSKDSLLLLSRYLQQLVMESLGKEFDLDGNRVNQGLTVYGNKGSTDQHAYIQQLREGVHNFFVTFIEVLRDRPPGHEWELEPSVTCGDYLFGMLHGTRSALYANDRESITVTVQEVNPRAVGALVALYERAVGLYAYLININAYHQPGVEAGKKAAGEVLALQKRILLVLNEASCKDPAEPLTLDQIADRCHCPEEIEMIYKIIQHMAANDRALIAEGNCGSPRSIKVYLGECNVDDDMNS

SEQ ID NO: 29998 - protein, 513 aa, Ralstonia metallidurans
MSGSPSPESEADAARLPYRIDRNFTRGLVWLRRDLRTDDNAALHYALKHCRQVWCVFVFDREILAPLLARGLHADRRVEFILRSLEPLRRALEDSGGGLIVLDGTARQAIPRLAAELEVEAVFANHDYEPAANDRDEAVRRTLAADSRVLLTFKDQVIFERDEILTGQGRPFSVFTPYKNAWLRTVRPFDLRPYPIEKHQETLAPVPQRYRGQLPTLADLGFTATNLAGIAMPTGSDGAHALFDEFLSRIGDYGRRRDFPAVRGPSYLSVHLRFGTISIRTLARAAHDTMLRGGAASEGATVWLSELIWRDFYFMILHHHPRVAEGKSFHAEYDGLRWIAPATGDRYFAAWCDARTGYPLIDAAMLQIRQSGYMHNRLRMVTASFLVKDLGVDWRRGEQYFADQLNDFDLAANNGGWQWAASTGCDAQPYFRIFNPVTQSEKFDPQGQFIRRYLPMLAALPDRYIHAPWTAPNEVLRAAGVTLGKDYPRPIVQHDVARKETLERYGVVKSAKA

SEQ ID NO: 29999 - protein, 535 aa, Magnaporthe grisea
MASSTISPQTTTTDLDSLETFLKPLQIDRPLVHRLAQDLCSNFTDLAAQSDDQFLPTPISESLLLQRAAVDSKDPGPHLAIDIGGTNLRVAFVELSHVRKDGHNETTLPLRRHLEHSWPIDSQLKNENHAVLFAWIGACIAEVVSKACAQFGITATTELPLGITFSFPMVQESLEKATLLQMGKGFGITSDLDLGCHLVDGYEKSRGDMPRIRVAAITNDAVATLVSFMHQFPTTADTNGTTAIDVDRRPAMGLICGTGSNATVFMDLESLKESKRPRRVQTLPGQNGGPASIRIAVNTEWSINGTAAPLRAHNLITSWDDHLSGAVERPGFQPLEYMTAGRYLGELGRLILVDYMTKVLGLDSTTLPAKLLRSFEPQNTTFLSHFRPEGNDWSMLVARLTNEFPSGPAFCWTEGLAQALYRIARLIEYRAAGIIAASTLALLKCSGALPSAEALASMYDRPTELQLGVGYTGGCITNFQDYLQHCQQLLDDLAVREYPEAASGGSRLRVVLQPCHDGGIDGAAVLVPAAVATGI

SEQ ID NO: 30000 - protein, 852 aa, Streptococcus thermophilus
MNTTEKIQTYLNDPKIVSVNTVDAHSDHKYFESLAEFSEGEMKLRQSLNGKWKIHYAQNTNQVLKDFYKTEFDETDLNFINVPGHLELQGFGSPQYVNTQYPWDGKEFLRPPQVPQESNAVASYVKHFTLNDALKDKKVFISFQGVATSIFVWVNGNFVGYSEDSFTPSEFEISDYLVEGDNKLAVAVYRYSTASWLEDQDFWRLYGIFRDVYLYAIPKVHVQDLFVKGDYDYQTKAGQLDIDLKTVGDYEDKKIKYVLSDYEGIVTEGDASVNGDGELSVSLENLKIKPWSAESPKLYNLILHVLDDDQVVEVVPVKVGFRRFEIKDKLMLLNGKRIVFKGVNRHEFNARTGRCITEEDMLWDIKVMKQHNINAVRTSHYPNQTRWYELCDEYGLYVIDEANLETHGTWQKLGLCEPSWNIPASEPEWLPACLDRANNMFQRDKNHASVIIWSCGNESYAGKDIADMADYFRSVDNTRPVHYEGVAWCREFDYITDIESRMYAKPADIEEYLTTGKLVDLSRVSDKHFASGNLTNKPQKPYISCEYMHTMGNSGGGLELYTDLEKYPEYQGGFIWDFIDQAIYKTLPNGSEFLSYGGDWHDRPSDYEFCGNGIVFADRTLTPKLQTVKHLYSNIKIAVDEKSVTIKNDNVFEDLSAYTFLARVYENGRKVSESEYHFDVKPGEEATFPVNFVVEASNSEQIYEVACVLREATEWAPKGHEIVRGQYVVEKISTETPVKAPLNVVEGDFNIGIQGQNFSILLSRAQNTLVSAKYNGVEFIEKGPKLSFTRAYTDNDRGAGYPFEMAGWKVAGNYSKVTDTQIQIEDDSVKVTYVHELPGLSDVEVKVTYQVD

SEQ ID NO: 30001 - protein, 566 aa, Oryza sativa
MNELCDLKVHINGHHTLLLHQSVMCAFSGRLRTMVTQEKKKRKTSRAESLSVKLADFPGGGEGFELVARFCYNNGRVPLCPSNLPLLHCAAVFLEMTEEVCTCNLLTQAEAFVDGLYYWTWADVLAAVKSCEPFAAAADASGLLERLISALFSKITANPETPVAAGAVGTPNRSSSSCSSSPDTLGFGRSSSTKTPESMKPCFAREWWFDDMTSLCPQTIEKAMRVLGCYGIENKNLILTRFLLHYLRAATRRPALCREGGGGLAGLADTAVHGVALVGGTAFSCRGLFWVLRIVSAVGLSKECRHKLERLMGLMLDQATLDDLLVSGDDGGVYDVNLVMRLVRVFVGSEEEADLPSQRMRKVGRLVDKYLGEISPDHGLRVSKFLAVAESLPDSARECYDGVYRALDIYLESHPTLTIEERTTLCRCLNYEKLTLEACKDLAKNRRIPPGIAVQALASQQSKLQIRPAAAAAKGTGGGRPDPSQTPRKIIVSGSRARSVDLDAMDEKELLKLNLQKMQNRVVELERACKEMRGQMSKMAKGGRPSSSFGAAACHQTGGRGLPRLC

SEQ ID NO: 30002 - protein, 852 aa, Streptococcus thermophilus
MNMTEKIQTYLNDPKIVSVNTVDAHSDHKYFESLAEFSEGEMKLRQSLNGKWKIHYAQNTNQVLKDFYKTEFDETDLNFINVPGHLELQGFGSPQYVNTQYPWDGKEFLRPPQVPQESNAVASYVKHFTLNDALKDKKVFISFQGVATSIFVWVNGNFVGYSEDSFTPSEFEISDYLVEGDNKLAVAVYRYSTASWLEDQDFWRLYGIFRDVYLYAIPKVHVQDLFVKGDYDYQTKAGQLDIDLKTVGDYEDKKIKYVLSDYEGIVTEGDASVNGDGELSVSLENLKIKPWSAESPKLYNLILHVLDDDQVVEVVPVKVGFRRFEIKDKLMLLNGKRIVFKGVNRHEFNARTGRCITEEDMLWDIKVMKQHNINAVRTSHYPNQTRWYELCDEYGLYVIDEANLETHGTWQKLGLCEPSWNIPASEPEWLPACLDRANNMFQRDKNHASVIIWSCGNESYAGKDIADMADYFRSVDNTRPVHYEGVAWCREFDYITDIESRMYAKPADIEEYLTTGKLVDLSSVSDKHFASGNLTNKPQKPYISCEYMHTMGNSGGGLQLYTDLEKYPEYQGGFIWDFIDQAIYKTLPNGSEFLSYGGDWHDRPSDYEFCGNGIVFADRTLTPKLQTVKHLYSNIKIAVDEKSVTIKNDNLFEDLSAYTFLARVYEDGRKVSESEYHFDVKPGEEATFPVNFVVEASNSEQIYEVACVLREATEWAPKGHEIVRGQYVVEKISTETPVKAPLNVVEGDFNIGIQGQNFSILLSRAQNTLVSAKYNGVEFIEKGPKLSFTRAYTDNDRGAGYPFEMAGWKVAGNYSKVTDTQIQIEDDSVKVTYVHELPGLSDVEVKVTYQVD

SEQ ID NO: 30003 - protein, 294 aa, Saccharomyces cerevisiae
TTPLVHVASVEKGRSYEDFQKVYNAIALKLREDDEYDNYIGYGPVLVRLAWHTSGTWDKHDNTGGSYGGTYRFKKEFNDPSNAGLQNGFKFLEPIHKEFPWISSGDLFSLGGVTAVQEMQGPKIPWRCGRVDTPEDTTPDNGRLPDADKDADYVRTFFQRLNMNDREVVALMGAHTLGKTHLKNSGYEGPWDATNNVFDNSFYLNLLNEDWKLEKNDANNEQWDSKSGYMMLPTDYSLIQDPKYLSIVKEYANDQDKFFKDFSKAFEKLLENGITFPKDAPSPFIFKTLEEQGL

SEQ ID NO: 30004 - protein, 468 aa, Pseudomonas putida
MTDSVEKIQLTRALKSRHIFMLSLGGVIGTGLFMGSGVTINQGGPVGAILAYLVAGLLMYLVMVCLGELSVQMPVSGSFQAHATKYIGPATGFMIGWVYWMSWATTVGLEFTAAGMLMTRWFPEVPIWYWSALFVVVLFGLNALATRAFGEAEYWFSGIKVATILGFIVIGLLVIFGAIPLSSGAPAPMLNNLVGESLFPHGLSAVFAVMMTVVYAFQGCEIMGVAAGETEHPEKSIPRAVRNVVFRVLIFYVLAIAVLSAIVPHEQAGLMESPFVQVFDMVGIPYAADLMNFVILTAILSVGNSGLYASTRILWAMSKTGMAPKSLSPLSKRGVPLRALSITLCFALISLMTSFVAADTLFMVLMAVSGMSGTVTWIVIALAQYRFRKAWLRDGGQLQDLKYKAPLYPLVPLLCITLCSSLFVFLALDETQRPSLYWGFGFIALCYAAYFFVNRRRQGAFAPSTPGV

SEQ ID NO: 30005 - protein, 615 aa, Bacillus halodurans
MCGITGWVDWRRNLQNETETIKQMAETQTHRGPDDLNVWTEKHAALGHSRLIVVDPEGGCQPMMRERNGKRYTIVYNGELYNTEDLRKELIVKGYQFQGHSDTEVLLVSYIEWGYQCVEKFNGIFAFAIWNDKDQSLFMARDRLGVKPLFYTVRHGFLLFATEIKALLAHPEIEPVLTEEGLSEVLGLGPSRSPGNGVFDDIQELRPAHLLTYDRNGAKVSRYWRLKSMAHSEDAMETAAHLRDLLEDTVERQLFADVPVGMFLSGGVDSSALTAIAALIYEREGKGLIRTYSIDYDENDKYFKANDFQPNADGPWVEKVSTTFRTNHHNAVISIEELANQLKRAVELRDLPGMADVDSSLYWFCKQIKKDVTVGLSGECADEIFGGYPWFHKPEVMNFNGFPWMRSADERQELLHERWRQKLNLPKYVHDRYKETIAETPRFEEDTPEEARRREISYLNMVWFMTTLLDRKDRMSMGASLEVRVPFSDHRIVEYAWNIPWEIKQFGGREKGILRKALEGILPDEVLYRKKSPYPKTHHPKYTKMVQQEMERILGQSDSPLFDVVNRKKLKELTETGGKALTTPYFGQLMTGPQLLAHFIQMEHWLKHYNIKLIG

SEQ ID NO: 30006 - protein, 469 aa, Arabidopsis thaliana
MSEEVPQQFPSSKRQLHPSLSSMKPPLVAPGEYHRFDAAETRGGGAVADQVVSDAIVIKSTLKRKTDLVNQIVEVNELNTGVLQTPVSGKGGKAKKTSRSAKSNKSGTLASGSNAGSPGNNFAQAGTCRYDSSLGLLTKKFINLIKQAEDGILDLNKAADTLEVQKRRIYDITNVLEGIGLIEKTLKNRIQWKGLDVSKPGETIESIANLQDEVQNLAAEEARLDDQIRESQERLTSLSEDENNKRLLFVTENDIKNLPCFQNKTLIAVKAPHGTTLEVPDPDEAGGYQRRYRIILRSTMGPIDVYLVSQFEESFEDIPQADEPSNVPDEPSNVPDEPSNLPSTSGLPENHDVSMPMKEESTERNMETQEVDDTQRVYSDIESHDFVDGIMKIVPPDLDMGVDYWFRSEVGEVSITDMWPDESGPDWNQMITFDQDHAGPSDNKILEQPQTPSSPTPEESTATRSPTGS

SEQ ID NO: 30007 - protein, 297 aa, Bacillus subtilis
MSHRKALLIHNGNAANKNIEKALGAVVPVLSHHLDEVIIKQTKKKDHAYHFCRSIDDSVDTVFILGGDGTIHQCINAISALERKPAVGILPGGTSNDFSRVLGIPQNLAKAAEALMAGKKTSVDVCQMNDRYFLNFWGIGLIAETSNQINETEKALLGKISYFTSALRTVSSAASFPMTLKIDGEEIKEEAVMLLVMNGQYIGTNRIPLPDASIEDGLLDVLICRNTNLTALRELMSMEQGSIDRFTGELSYVQASRIEIETDTAKKADMDGEVYTHTPAVIQVLPQHIDMLVPANE

SEQ ID NO: 30008 - protein, 112 aa, Escherichia coli
MKLVTVIIKPFKLEDVREALSSIGIQGLTVTEVKGFGRQKGNAELYRGAEYSVNFLPKVKIDVAIADDQLDEVIDIVSKAAYTGKIGDGKIFVAELQRVIRIRTGEADEAAL

SEQ ID NO: 30009 - protein, 389 aa, Bacillus subtilis
MEKKNITLTILLTNLFIAFLGIGLVIPVTPTIMNELHLSGTAVGYMVACFAITQLIVSPIAGRWVDRFGRKIMIVIGLLFFSVSEFLFGIGKTVEMLFISRMLGGISAPFIMPGVTAFIADITTIKTRPKALGYMSAAISTGFIIGPGIGGFLAEVHSRLPFFFAAAFALLAAILSILTLREPERNPENQEIKGQKTGFKRIFAPMYFIAFLIILISSFGLASFESLFALFVDHKFGFTASDIAIMITGGAIVGAITQVVLFDRFTRWFGEIHLIRYSLILSTSLVFLLTTVHSYVAILLVTVTVFVGFDLMRPAVTTYLSKIAGNEQGFAGGMNSMFTSIGNVFGPIIGGMLFDIDVNYPFYFATVTLAIGIALTIAWKAPAHLKAST

SEQ ID NO: 30010 - protein, 390 aa, Fusobacterium nucleatum
DSYRANRDDIIWIGVNDRKTERFENYIPLDNGITYNSYLIMDEKICIIDGVEEGENENFLSKIEAMIGNTPIDYIIVNHVEPDHSGSIKSMLKIYPELKVVGNAKTIMMLKLLGVDLPDERAVTVKEKDILDLGKHKLTFYLMPMVHWPESMATYDITDKILFSNDAFGSFGALDGAIFDDEINTDFFTDEMRRYYSNIVGKFGAPVNAVLKKLSSVEISCICPSHGLVWRKYIKEIIERYQKWANMEATKEGVVIVYGSMYGHTAEMAEVLGRELGNRGIKDVIIYDSSKTDHSYIFSTIWRYKGLMLGSCAHNNDIYPKMEPLLHKLENYGLKNRYLGIFGNMMWSGGGVKRIKEFADTLTGLEQIGEPIEIKGHITPDERDRLVELA

SEQ ID NO: 30011 - protein, 360 aa, Hordeum vulgare
MVQPVFDAAVLSGRTDIPSQFIWPEGESPTPDATEEMHVPLIDIGGMLSGDPRAAAEVTRLVGEACERHGFFQVVNHGIDAQLLADAHRCVDAFFTMPLPEKQRALRRPGESCGYASSFTGRFASKLPWKETLSFRSCPSDPALVVDYIVATLGEDHRRLGEVYARYCSEMSRLSLEIMEVLGESLGVGRAHYRRFFEGNESIMRLNYYPPCQRPLETLGTGPHCDPTSLTILHQDDVGGLQVHTDGRWRSIRPRADAFVVNIGDTFMALSNGRYKSCLHRAVVNSRVPRKSLAFFLCPEMDKVVAPPGTLVDAANPRAYPDFTWRSLLDFTQKHYRADMKTLEVFSSWVVQQQPASART

SEQ ID NO: 30012 - protein, 558 aa, Magnaporthe grisea
MLAKDHGLQDTNDRFLGNIQRNGTFSVVPRVSGGEITPEKLIAMGEVAKEYGLYTKITGGQRIDMFGAKKQDLLDIWGKLVNAGMESGHAYAKSLRTVKSCVGTTWCRFGIGDSVGMAVRLEERYKSIRAPHKIKGGVSGCVRECAEAQSKDFGLIATDKGFNIYVAGNGGAKPRHAELLAKDVPPSEVVPILDRYLMFYIRTADKLQRTARWLENLPGGIEYLREVVLKDKLGINAALEAAMEELVDGFFDEWAEAIQDPAIAAKFRQFANTDDKLDNMEVEVERDQLRPVHWPKEAAKEDFKGLRSRWTETAWQPVMEASYFAEADGLPNGISAAIRRGDTQLALWRIRGRYFLTQQMCPHKRAFILSDGLIGEEMSCSKEKGDNGSGITNGAAANGSLGVTNGGTNGMGVADAKRTAASGDGGGGGSCNKNGNAAPWVSCPHHKRNFDLSSGACKNDEELSIATFEVEERPDGHVYAKLPPVEELDAALGTSKWKVKLGDAGEGEHPFAELDRKIAFKGLRAKKVGLRPTAATLPLKSKNLAVAVGGGCGSAPDW

SEQ ID NO: 30013 - protein, 355 aa, Hordeum vulgare
MASLVFDAAVLSRKEDIPPQFIWPADEAPSVDGVEEIVVPVVDLAGFLAGDDAGLNELVAACERHGFFQVVNHGVDPALLAKAYRCCDAFYALPLAEKQRAQRRLGENHGYAGSFVGRFGSKLPWKETMSFNCSAAPESARKVVDYFVGVLGEEYRHMGDVWQEYCNEMTRLALDVTEVLAACLGLDRGALRGFFAGDDSLMRLNHYPPCKKPHLTLGTGPHHDPTALTLLHQDDVGGLEVFTGGAWRAVRPRSDAFVVNIGDTFSALTNGRHVSCLHRAVVNGSLARRSLTFFLNPQLDRPVTPPAELLAIDGRPRVYPDFTWREFLEFTQKHYRSDSRTLDAFVAWINQGHTG

SEQ ID NO: 30014 - protein, 438 aa, Thermus thermophilus
MRVFIDEIARHVDQEVELRGWLYQRRSKGKIHFLILRDGTGFLQATVVQGEVPEAVFREADHLPQETALRVWGRVREDRRAPGGFELAVRDLQVVSRPQGEYPIGPKEHGIDFLMDHRHLWLRHRRPFAVMRIRDELERAIHEFFGERGFLRFDAPILTPSAVEGTTELFEVELFDGEKAYLSQSGQLYAEAGALAFAKVYTFGPTFRAERSKTRRHLLEFWMVEPEVAFMTHEENMALQEELVSFLVARVLERRSRELEMLGRDPKALEPAAEGHYPRLTYKEAVALVNRIAQEDPEVPPLPYGEDFGAPHEAALSRRFDRPVFVERYPARIKAFYMEPDPEDPELVLNDDLLRPEGYGEIIGGSQRIHDLELLRRKIQEFGLPEEVYDWYLDLRRFGSVPHSGFGLGLERTVAWICGLAHVREAIPFPRMYTRMRP

SEQ ID NO: 30015 - protein, 183 aa, Escherichia coli
MQDSILTTVVKDIDGEVTTLEKYAGNVLLIVNVASKCGLTPQYEQLENIQKAWADRGFVVLGFPCNQFLEQEPGSDEEIKTYCTTTWGVTFPMFSKIEVNGEGRHPLYQKLIAAAPTAVAPEESGFYARMVSKGRAPLYPDDILWNFEKFLVGRDGKVIQRFSPDMTPEDPIVMESIKLALAK

SEQ ID NO: 30016 - protein, 527 aa, Gibberella zeae
MPNPTVAIVGLGALGLVTLKNLREEGFDAVGLDRNDYVGGLWHFEEGNKLTVMRSTLSNGSKQRGCFTDFPFPEDSPDFIPAEGIDRYLKDYAKHFGLLEHCRLRTSFHGARYDEKKQQWRLSLSTPDAPEPHFEWFDKVVFAMGADQIPSRPKIEGIEKFKGHVEHSMSFKNPETLAGKRVMVLGFGNTAADMATELAPIADQVYLAHRHGAIIVPRWVKGKPVDHVRTYRKYVILNLMNRYTPGLWEKTMNSVIGKLVHNTFDLKPEWRFDPAPSITNQRPLVNDELIPSLEKGSIISTHGLARVIDENTVETSDGQRYEVDAILFCTGFTVDYSVVGMDADPCRATTTDWQKSRGFTGRPLPRLYQNIFSLDHPETLAFIGHLSFMNPAFFMFDLASMAVAQLWKDPSGFPSKAEMNKQVDDQHAWVIDLAKKGPVTPSIVKASEWMEWVDRVIGSGLPEHLGYTMKGWNFWMRDRKFCNIMMDGLLSPHAYRVFPGKRKAWPGARDAIIAMNADREARFGPMD

SEQ ID NO: 30017 - protein, 203 aa, Rhodopseudomonas palustris
MIPPPQLDAKEAGGIQTAVFAGGCFWGVQGVFQHTAGVVNALSGYAGGSKASASYPLVSTGTTGHAEAVEVKYDPKRISYGKLLQIYFSVAHDPTQLDRQGPDTGPQYRSAIFTTSDEQKRIADAYIAQLDAAKVFGAPIVTKVGPLKGFYAAEAYHQDYLTLHPTQPYIAYNDLPKIEALKKLFPTEYLDKPTLVSSVKATN

SEQ ID NO: 30018 - protein, 379 aa, Bacillus cereus
MVAEKGTQTKTQQQREQHFELLNSTQIVISEALEKLGYPNEVYELLKEPIRMMTVKIPVRMDDGTVKIFTGYRAQHNDAVGPTKGGIRFHPNVTENEVKALSIWMSLKCGIVDLPYGGGKGGIICDPREMSFRELERLSRGYVRAISQIVGPTKDIPAPDVFTNSQIMAWMMDEYSRIDEFNSPGFITGKPLVLGGSHGRETATAKGVTICIREAAKKRGIDIKGARVVVQGFGNAGSFLAKFMHDAGAKVIAISDAYGALHDPNGLDIDYLLDRRDSFGTVTKLFNNTISNKELLELDCDILVPAAIENQITEENANDIKAKIVVEAANGPTTLEATKILTDRGILLVPDVLASAVWLPVSTLSGSKTPKVTTGLRRK

SEQ ID NO: 30019 - protein, 317 aa, Treponema denticola
MSEKYDLVIIGGGPGGMAAGIYAARSKLKTVILEEKPNQGGQCYITEEIENYPGFPESSGPALTEAFKKHAEKFGVEFKRARAEKIELVPNSPTRIVHGSDGVKYECLAVVVATGASARELGCKGEKEHWGKGVSYCATCDGAFFEECEIVVIGGGDSAVEEAMYLTKFADKVTIIHRRDELRAAKSIQEKAFANPKMAFKWNAVVEEVCGEGLVDSVILKDTKTGETSKFDTEGVFVFIGHNPQTAFIQGLVDLDENGYILTNGKMETNVPGIYGVGDVIQKESRQVVTAAADGALAGIWAGHYIDDIKAKMAMKK

SEQ ID NO: 30020 - protein, 137 aa, Idiomarina baltica
MSEFINIISHERRLNAALKELDLNELYDIQKKLSNVISKREEDALEQEKALEEKRQKVAELKRNMQEAGIDISDILEDEIGGDKLVSPKRKRAPKPPKYEFKDENGELKTWTGQGRMPKALQNALDNGRALEEFLIK

SEQ ID NO: 30021 - protein, 157 aa, Zea mays
MGPGALLPRSAVPYFSLAPGRGRSASGTRSRNLALSASSSNGAAVPSLTTDSEKKGPVIMEIPLDQIRRPLMRTRANDPVKVQELMDSIRVIGLQVPIDVLEVDGVYYGFSGCHRYEAHQRLGLPTIRCKVRRGTKETLRREHLPSAWIPFLNYLMH

SEQ ID NO: 30022 - protein, 321 aa, Rhodopseudomonas palustris
MPSPVQAKVVIIGSGPAGYTAAIYASRAMLEPILIQGMQPGGQLTITTDVENYPGFADVIQGPWLMEQMEKQALHVGTRIKTDLVVDLDLSQQPFRLTCDSGDVYLADTLILATGAQARWLGIPSEQTYKGFGVSACATCDGFFYRGKDVVVVGGGNTAVEEALFLTNFAASVTIVHRRDHFRAERILQDRLFKHPKIKVIWDVAVDEICGAENPTKVTHVRLKNVKSGTTSEVKADGVFIAIGHAPATELFKDQIKLKPSGYVEVAANSTATSVPGVFAAGDVADETYRQAVTAAGMGCMAALEAERFLALRAGDRQAAE

SEQ ID NO: 30023 - protein, 129 aa, Ostreococcus tauri
MSDAKVRRASCSVKRANRGRSTVRVEAVSVEIRHEGQTVTVEVGDDDNILDVALDAGLDLRYDCKMGVCMMCPAKVLSGAVDQSGSMLSDDVEEKGYALLCCAKPEGEGVVIQTVSEDELLEEQLCSSG

SEQ ID NO: 30024 - protein, 138 aa, Unknown
  Synechococcus sp. CC9311
MIGLEWKTLMNPVSRRLSDIERTGPADSDRSDLCALHPSMASYKVTLVSESEGLNKTIEVPDDQYILDAAEEQGIDLPYSCRAGACSTCAGKITAGTVDQSDQSFLDDDQIEAGFVLTCVAYPTSDCTIKTHAEEELY

SEQ ID NO: 30025 - protein, 179 aa, Ostreococcus tauri
MGAFQSKRPSSVIDACDTFDQLPSEPLHDGTAFDFASTRGGVVLVVNVASYCGLTTKNYEDFKLLQDRFGDDLTILAFPCNGFMFQEPFGAKSACAFARKRGFKGMVFQKVKVNGSGASETFKWLKSRAGVRRIEWNFGKFLIDRDGKVRGYYPPQTRPRVFEGDVEALIGEKATEALA

SEQ ID NO: 30026 - protein, 328 aa, Oryza sativa
MDFHHGDADDFALEFIREHLLGVDGATATATEPADLEVVEPAAAYPPMSWQEQRQQEQHGCHVELTDEHLESAPAAEAAAAFRTAPAQPAAEVMIKFGGEPSPVRPSSSLTISLPPSSFGSWASAAAPAAAAVEDFRKYRGVRQRPWGKFAAEIRDPKRRGSRVWLGTYDTPVEAARAYDRAAFRMRGAKAILNFPNEVGTRGAELWAPPPPPPAHSAAASTTNKRKRQPSEDPDDGVEVIGVVSKAVKTEAPTSNSSSLSSSLTSRDTTPATSSAGAEHAGAAAESSPATPSSWSWEQYWEALLGGLPPLSPLSPHPALGFPQLTVN

SEQ ID NO: 30027 - protein, 240 aa, Oryza sativa
  misc_feature (80)..(80): Xaa can be any naturally occurring amino acid
MSSTNSSGDPAAVRVVGGWASPFMNRVVVALKLKGVEHEMLQETVGKKSELLLRSNPVHKKIPVLLHHGKPIAESLIIVXYIDEVWPASNGAPSILPRDPYGRAVERFWAKYIDDKIPPGIRVLRGSVEEDKDKAAGEMSTALQHLEEAFVKCSQGKQYFGGDNIGYLDIALGSFLGWIRAVEKIAGVELLNETKVPNLAAWADRFCAHPAVVDVVPDADRLVEFTVQHAALLRAVNVPK

SEQ ID NO: 30028 - protein, 240 aa, Unknown
  Synechococcus sp. CC9311
MLPSWLTGQTTQSQPSSDQGRHVVLGTALNAPLMDDQEEALFGCGCFWGAEKGFWRLPGVVSTAVGYAGGKVENPSYEQVCSGRTGHSEVVRVVWSTTAIDFSDLLKLFWECHNPTQGDQQGNDRGSQYRSAIYTSTEHQAELALASRDWYQSALSKQNTAAITTEIAANQVFFRAEEYHQQYLARPGSRPYCSAMPSGVLLGDFAGANYKLPSSVWSHYDWSINHCVLRGDNSPISLKA

SEQ ID NO: 30029 - protein, 361 aa, Nicotiana tabacum
MDSALPVSAIGFEGFEKRLEISFFEPGLFADPNGKGLRSLSKAQLDEILGPAECTIVDSLSNDDVDSYVLSESSLFVYSYKIIIKTCGTTKLLLAIPPILKLAETLSLKVQDVRYTRGSFIFPGAQSFPHRHFSEEVAVLDGYFGKLAAGSKAVIMGSPDKAQKWHVYSASAGPIQSNDPVYTLEMCMTGLDREKASVFYKTEGSSAAHMTVRSGIRKILPNSEICDFEFEPCGYSMNSIEGAALSTIHITPEDGFSYASFEAVGYDMKTMKLGPLVERVLACFQPDEFSIALHADVATKLLERVCSLDVKGYSLAEWSPEEFGKGGSIVYQKFTRTPFCGSPKSVLKGCWKEDEEKEEKE

SEQ ID NO: 30030 - protein, 638 aa, Magnetospirillum magnetotacticum
MCGFAGFLDLTQATPDRERVVRAMAATLLHRGPDDDGAWVDDGAGVALGFRRLAIIDLSPQGHQPMTSHDGRWVISFNGEIYNHEALRARLGEDIGWRGHSDTEVLLQAVSAWGMERALAEFDGMFAFALWDRQDRVLTLARDRFGEKPLYWTQSGGHLLFGSEIKALRAHPAWTGGIDRDALALYMRLGWITAPHTIHSGVFKLEPGHVMRVSEGQISTQAYWSAAECAAGVENGFTGNAEAAADRLEELLRQSVRLRMQADVPVGVFLSGGIDSSITAALMRQLSSEPVHSFTIGFDQSGLDESPHARAVADHLGTIHTEVRISDAEALAQVPRLPLLYDEPFADAAALPTALLAQVTRKSVTVALSGDGADELFGGYGIYRSIPKDWGRLRGLPGGLKSLGALGARQLAEPAEGLAALAGRFAKRRSHPGHRLRREAERLEVQSLAGLLGLHYSRWRGMPALVPGAREAQSLFSAPTPALKDDALATMVLDACGYLPDDLCVKTDRATMGASLEARLPFLALEIAQFAWSLPTGLKIEGETGKAVLRRVLYRHVPRALVDRPKMGFEVPLRRWLNGQLRDWADDLLSEDRLRRQGFLDTALVAQCWREHRSGAKNWQNEIWHALMFQAWLDSVNP

SEQ ID NO: 30031 - protein, 852 aa, Streptococcus thermophilus
MNTTEKIQTYLNDPKIVSVNTVDAHSDHKYFESLAEFSEGEMKLRQSLNGKWKIHYAQNTNQVLKDFYKTEFDETDLNFINVPGHLELQGFGSPQYVNTQYPWDGKEFLRPPQVPQESNAVASYVKHFTLNDALKDKKVFISFQGVATSIFVWVNGNFVGYSEDSFTPSEFEISDYLVEGDNKLAVAVYRYSTASWLEDQDFWRLYGIFRDVYLYAIPKVHVQDLFVKGDYDYQTKAGQLDIDLKTVGDYEDKKIKYVLSDYEGIVTEGDASVNGDGELSVSLENLKIKPWSAESPKLYNLILHVLDDDQVVEVVPVKVGFRRFEIKDKLMLLNGKRIVFKGVNRHEFNARTGRCITEEDMLWDIKVMKQHNINAVRTSHYPNQTRWYELCDEYGLYVIDEANLETHGTWQKLGLCEPSWNIPASEPEWLPACLDRANNMFQRDKNHASVIIWSCGNESYAGKDIADMADYFRSVDNTRPVHYEGVAWCREFDYITDIESRMYAKPADIEEYLTTGKLVDLSRVSDKHFASGNLTNKPQKPYISCEYMHTMGNSGGGLELYTDLEKYPEYQGGFIWDFIDQAIYKTLPNGSEFLSYGGDWHDRPSDYEFCGNGIVFADRTLTPKLQTVKHLYSNIKIAVDEKSVTIKNDNVFEDLSAYTFLARVYENGRKVSESEYHFDVKPGEEATFPVNFVVEASNSEQIYEVACVLREATEWAPKGHEIVRGQYVVEKISTETPVKAPLNVVEGDFNIGIQGQNFSILLSRAQNTLVSAKYNGVEFIEKGPKLNFTRAYTDNDRGAGYPFEMAGWKVAGNYSKVTDTQIQIEDDSVKVTYVHELPGLSDVEVKVTYQVD

SEQ ID NO: 30032 - protein, 323 aa, Escherichia coli
MSKIFEDNSLTIGHTPLVRLNRIGNGRILAKVESRNPSFSVKCRIGANMIWDAEKRGVLKPGVELVEPTSGNTGIALAYVAAARGYKLTLTMPETMSIERRKLLKALGANLVLTEGAKGMKGAIQKAEEIVASNPEKYLLLQQFSNPANPEIHEKTTGPEIWEDTDGQVDVFIAGVGTGGTLTGVSRYIKGTKGKTDLISVAVEPTDSPVIAQALAGEEIKPGPHKIQGIGAGFIPANLDLKLVDKVIGITNEEAISTARRLMEEEGILAGISSGAAVAAALKLQEDESFTNKNIVVILPSSGERYLSTALFADLFTEKELQQ

SEQ ID NO: 30033 - protein, 190 aa, Brassica napus
MAEVMLPMKMEMANDPSKFTSPDLLHVLAVDDSHVDRKFIERLLKVSSCKVTVVDSATRALQYLGLDVNEKPIGCKDLKVNLIMTDYSMPGMTGYELLKKIKESSAFRDVPVVVMSSENILSRIDRCLEEGAEDFLLKPVKLSDVRRIRDSLIKVEDLSFTKSINKRELETENVYSLDSSVPLQLKRTKI

SEQ ID NO: 30034 - protein, 519 aa, Medicago truncatula
MASSESNSQMKVVHGDAGYILEDVPHLSDYVPNLPTYPNPLRSNPAYSVVKQYFVHMDDTVPQKVVVHKDGPRGVHFRRAGPRQKVYFRSDDVIACIVTCGGLCPGLNTVIREIVCGLSYMYGVDKVLGIDGGYRGFYSKNTITLTPKVVNDIHKRGGTILGTSRGGHDTGKIVDSIQDRGINQVYIIGGDGTQRGAAVIYEEVRRRGLKVAIAGIPKTIDNDIPVIDRSFGFDTAVEEAQRAINAAHVEAESVENGIGVVKLMGRYSGFIAMHATLASRDVDCCLIPESPFYLEGKGGLYEFITKRLKESGHMVIVIAEGAGQDLLTESMQDMDQKDASGNKLLQDVGLWISHKIKDHFAKENKMAIVLKYIDPTYMIRAIPSNASDSVYCTLLAQSAVHGAMAGYTGFTAGLVNGRHTYIPFNRITEKMNNVVITDRMWARMLSSTNQPSFLKPKDVHQIMKAGQSPTQLLEGSNCNGGGEEAKKVEQIPTQLMEGDKSKDNQKSRNLADSDSCIKK

SEQ ID NO: 30035 - protein, 369 aa, Gloeobacter violaceus
MVALVVKIGTSSLSDPSTGDLRLATLGGLAETLTRLRRAGHRIILVSSGAVGVGCARLGLKERPATVAGKQAAAAVGQGLLMSMYDRLFGALGQPVAQVLLTRQDLMDRVRYLNARETLSELWRLGTVPIVNENDTVATDELRFGDNDALSALVAGLVEAQWLVLLTDVAGLYSANPRLDPQARLLSEVTEISEELLQSARGRSLWGSGGMASKLEAARIAASAGVATVITEGNTPQNIERILAGEAIGTRFALARPGGRLSLRKRWIGYGLVPAGALHLDEGAVLAVREGGKSLLPAGVRGVEGRFETGALVRLIDGQGLEFARGLVNYSSEELEKIRGRKSHEIAALLGIEGQPPTAVHRDNLVTLS

SEQ ID NO: 30036 - protein, 533 aa, Desulfitobacterium hafniense
MVTITSWKRFKEYLYYDQELGLLLDISRMNFSAEFLRSMAEPMREAYHQLQLLEKGALANPDEGRMVGHYWLRNPDLAPTEEIVQDIKETLKEILDFAEQIHSGRLQGEKGNPFRNILLVGVGGSILGPRFVADALASSRDKMKAFFIDNGDPDGIDRVLSRIGEELPATLCLIISKSGGTIETRNGMLEVRRAYKEAGLSFPDHAVAITQRGSQLDKLSQKEGWLRAFPMWDWVGGRTSLLSAVGLLSLALQGIDVAGLLQGAKDCDGRTRRPDTLDNPGALLALMWYYSTQGQGGKQMVVLPYKDRLELFTKYLQQLIMESLGKEKNLQGETVHQGITVYGNKGSSDQHSYLQQLLEGPDNFFVTFIEVLKDRQGPSTYMEENSTSGEYLQAFLLGTREALTQKGRESLTITVKEVNAYTIGVLIALFERAVSIYALLVGINAYHQPAVEMGKKAAGQAIQLKNNIVEFLKSHPGKKFSVSELALAIQEEEHQEMVFKLLLHLTTNPEHGVNMEPGEPWPESRFFVGGPIS

SEQ ID NO: 30037 - protein, 545 aa, Aquifex aeolicus
MRKWIVAFSLFSISFSNPYFDALMCAYLSDKPKIAQNYCLSALEKIPSPELYKDTIKVLLRNKEYEKAKELAKEFLETYPDEPQAYIYLYTIYKFLKEDKKAFEVIKEAYKSFPFNENVVLFLANEYINKGKLREAEKVLLEYMETDPDNPLPYYLLGRIYLAKGDIQKGMEYFLKALEKKKYYAPAVLSLGNLYLQEKKFKEAEELYKSVLEKYPNSPKILEKLAKLYTASGRIEEAIKIYEKLINLKPRNVNYKTEYALLLLSTGEFDKAKKILEELYYVNPSNPNVAFAYALTLEATGELKKAKEIYENLLNRFPENIKVIERLIGIYLDLGNYEDAKRLIEKAKVLAPDKKEILFLEADYYSKTKQYDKALEILKKLEKDYPNDSRVYFMEAIVYDNLGDIKNAEKALRKAIELDPENPDYYNYLGYSLLLWYGKERVEEAEELIKKALEKDPENPAYIDSMGWVYYLKGDYERAMQYLLKALREAYDDPVVNEHVGDVLLKMGYKEEARNYYERALKLLEEGKQGERGQKERLLKKLENL

SEQ ID NO: 30038 - protein, 261 aa, Photorhabdus luminescens
MMNSGKVWLVGAGPGDAALITVRGLHCIRQAEALVYDRLVSPDLLSEAPDDCKMINVGKTPNYHPVPQQQINQILVECAQQGLNVVRLKGGDPYVFGRGGEEAEALALAKIPFEVVPGISSSIGGLACAGIPVTHRDYASGFHVVTGHLRQENESQDWATLAKLEGTLVILMGMTQLASICEQLIAGGKAPTTPAAVVMYASHQQQQVASATLLTLAQQVAAQGLSAPALIVIGDVVRLRETLAFSRDHLLLSSVPSLMAL

SEQ ID NO: 30039 - protein, 355 aa, Pseudomonas putida
MYPKNTWYVACTPDEIATKPLGRQICGEKIVFYRARENQVAAVEDFCPHRGAPLSLGYVEDGNLVCGYHGLVMGCDGKTVSMPGQRVRGFPCNKTFAAVERYGFIWVWPGDQAQADPALIPHLEWAVSDEWAYGGGLFHIGCDYRLMIDNLMDLTHETYVHASSIGQKEIDEAPPVTTVTGDEVVTARHMENIMAPPFWRMALRGNGLADDVPVDRWQICRFTPPSHVLIEVGVAHAGKGGYHAEAQHKASSIVVDFITPESDTSIWYFWGMARNFAAHDQTLTDNIREGQGKIFSEDLEMLERQQQNLLAHPERNLLKLNIDAGGVQSRKVLERIIAQERAPQPQLIATSANPA

SEQ ID NO: 30040 - protein, 378 aa, Desulfitobacterium hafniense
MKGGGIMTNAIGMIFGNLNSSALQGLDPNRPIGTVPFGGRYRLLDFALSSMVNSGIHTVGLITPQQYRPMLDHLGAGRDWSLDRKSGGLFFLPGVIHSLNHTVHFSLQDIAVNIDFLEKDCAKNIIISSSDQVFNLDFRPVLEEHEQAQADITLVYNQSVHPPEGSDRIYLRMNAHKKVTAMSKSKEVAGLQSPWNYFIDILIIRRELLLQMLRGYGSIGTIELSEVIAHHLDIINVQGYFCGGYVGRIRSVQDYFLNNMALLQEEVRRDLFINTRPIRTKIRDNPPTKYGKQAQVKNSLISSGCTLEGKVENTILSRGVVIEEGCEVRNCIIMSKCVIGKHSVLENLIMDKFVEINEGSVLKGQPNKLMVIPKKAVI

SEQ ID NO: 30041 - protein, 398 aa, Desulfitobacterium hafniense
MRKKECIAMLLAGGQGSRLGCLTRNIPKPAVSFAGKYRIIDFSLSNCSNSNIDTVGVLTQYKPFALNTYINMGSAWDLNCLNGGIHILPPFVGEAQGSWYKGTANAIYQNMDFINFYNPEYILILSGDHIYQMDYYEMLSYHKQKHAEVTLSAIAVPWEEASRFGVMVTDAGGRIIRFEEKPPRPESNLASMGVYIFKWDVLKEALLEDEQDPQSDHDFGKNVLPRLLQQGRRLYSYLFHGYWRDVGTIESYYNANMEVLQEERVDKFFELKQRVFSNEEILAPQHLGERAKIHNSLIGNGCTILGEVRDSVIASGVYVGEGSLIEQSILLPNSEIYEDVRLHKTILGENAIVRAHCRIGDKREGNPPQEGITVIGDHLHIPEGTVISEGENVRKDTA

SEQ ID NO: 30042 - protein, 718 aa, Oryza sativa
MSASPSSMSGAGAGEAGVRTVVWFRRDLRVEDNPALAAAARAAGEVVPVYVWAPEEDGPYYPGRVSRWWLSQSLKHLDASLRRLGASRLVTRRSADAVVALIELVRSIGATHLFFNHLYDPLSLVRDHRVKALLTAEGIAVQSFNADLLYEPWEVVDDDGCPFTMFAPFWDRCLCMPDPAAPLLPPKRIAPGELPARRCPSDELVFEDESERGSNALLARAWSPGWQNADKALAAFLNGPLMDYSVNRKKADSASTSLLSPYLHFGELSVRKVFHQVRMKQLMWSNEGNHAGDESCVLFLRSIGLREYSRYLTFNHPCSLEKPLLAHLRFFPWVVDEVYFKVWRQGRTGYPLVDAGMRELWATGWLHDRIRVVVSSFFVKVLQLPWRWGMKYFWDTLLDADLESDALGWQYISGSLPDGRELDRIDNPQLEGYKFDPHGEYVRRWLPELARLPTEWIHHPWDAPESVLQAAGIELGSNYPLPIVELDAAKTRLQDALSEMWELEAASRAAMENGMEEGLGDSSDVPPIAFPPELQMEVDRAPAQPTVHGPTTAGRRREDQMVPSMTSSLVRAETELSADFDNSMDSRPEVPSQVLFQPRMEREETVDGGGGGGMVGRSNGGGHQGQHQQQQHNFQTTIHRARGVAPSTSEASSNWTGREGGVVPVWSPPAASGPSDHYAADEADITSRSYLDRHPQSHTLMNWSQLSQSLTTGWEVEN

SEQ ID NO: 30043 - protein, 886 aa, Zea mays
METGAAAAPASRADGVRRCKILVPWRFQPGFVRQPLKQAANDAAVNGDGGNTAGAPDAKSCRADGAASDGGETNVFRDAKKFGSGRATRGKNGEVDGGEEHSERCTSSQSLKSPDVENGGRPGPGDACNLGESVRGGWVKSSPLEGTGNSRGANGGVEAGEDYNLGSSNCDASWKDARTQEFRGAGDGAACDPEVIESNVGAEKCFAKGLKKPFMDQTGSKSNGSSAPGLESEDPEGNVGLEDSSYQAAKGCSMGDGAAKENEATANGCSSATPGSIGNGTYVRKGRKAAVPWRFQARYKRSFSDAFGSNNESPDLPAYMFDSSSTQCTPATRSTVRCYASAHSGVRVSAMNNFSVKGDTECKKRKTNNDYQDESMLNNGGVVVRERIMRSLQDLRLIYRDLLDEEDNSREKVLNVRPDLKAYRIFRERFCTDFDDEKYIGSVPGIYPGDIFHLRVELCVVGLHRPHRVGIDCTKKDDGTTVAVSIVSCAQSHDIKYNLDAFVYTGLVAVAVNQRIEGTNLALKKSMDTNTPVRVIHGFTTFNGKKKFPAYIYGGLYLVEKYWREKEHGDRYVYMFRLRRMEGQKHIDIQEILQTGNSGSNDNVIIKDLSRGLERVPLPVVNKISDERPMPYCYISHLRYPRNYRPTPPAGCNCVGGCSDSNKCACAVKNGGEIPFNDKGRIVEAKPLVYECGPSCKCPPTCHNRVGQHGLKFRLQIFKTKSMGWGVRTLEFIPSGSFVCEYIGEVLEDEEAQKRTNDEYLFAIGHNYYDKSLWEGLSRSIPSLQKGPGKDDENETGFAVDASEMGNFAKFINHNCTPNIYAQNVLYDHEDISVPHIMFFACDDIRPNQELAYHYNYKIDQVHDANGNIKKKKCLCGSVECDGWLY

SEQ ID NO: 30044 - protein, 242 aa, Zea mays
  misc_feature (31)..(31): Xaa can be any naturally occurring amino acid
MAGDGELKLLGMWASPFVLRARLALSFKGLXEYEYVEEEIFGNKSELLLESNPVHKKVPVLIHNGKAICESQIIVQYISEVYDGTGPSLLPVGAYDRAVARFWAAYVDDKVFSSFMMMIMGKTDDEKAEGRKQLFAAAETLEGALKECSCSKGRPRPFFGGDSVGYVDIALGGFVAWVQTRDLLSGLEHFDADKTPLLATWLERFCALNETKAVMPDVMKLLEFSKKRQAQADAAAAAVVLR

SEQ ID NO: 30045 - protein, 367 aa, Hyacinthus orientalis
MGDPVTFQFFPVGEPEEEESPGGESTVAAGGAPRGHWAEVKFVEKEADVSPAIKKSRRGPRSRSSQYRGVTFYRRTGRWESHIWDCGKQVYLGGFDTAHAAARAYDRAAIKFRGVDADINFNLSDYNEDLKQMMNLAKEEFVHILRRQSTGFSRGSSKYRGVTLHKCGHWEARMGQFLGKKAYDKAAIKSSGREAVTNFEPSSYEREVLTEADSDAIGHDIDLNLRISQPNVSSPKRRDNPVGVQFHLGSFESSDAKKAMIDTHSSILVGQPHTAAMTSEASRVWSALYPGFYPPIELRAKDKMSMVGSAALPNWTWQLHGPMPSPMFTSAASSGFATTHATSSITPPASHHLQFPPPPNTNYYSRS

SEQ ID NO: 30046 - protein, 521 aa, Oenococcus oeni
MKFEEFGLSPELLSAVKKHGYDEATPIQEKTIPLIIQGVDVIGQAQTGTGKTAAFGLPILEEVDPKNPQIQALVISPTRELAMQTEEELNKLGSDKHVKTQVVFGGYDIRRQIHALKEHPQILVGTPGRLIDHLNRHTIDFRGVKTLVIDEADEMLNMGFLEDIETIVHYTPDDRQTLLFSATMPDDIKKIGVKFMEDPEEVHIASKGLTIDLVDQYLVNTREYEKFDAMTRLFDVEQPELAIVFGRTKRRVDELTKALQLRGYKAAGIHGDLDQAARMRTLRSFKKGELQFLVATDVAARGLDISGVTHVYNYDVPQDPESYVHRIGRTGRAGHHGVSVTFVVRGEIDYLRAIEKLINKRMAALKPPSAEEAHIARLKNAKAETYAVLGKTTIDNVEDEATEIANQYDAKLIAAALLHALSKDDERTRPVDIAQEKPLPRRHSSSDHGHNFRSGRSNGNRGRNGHSNGNRGGRRGGFKEEFVIDRGHKPVDRRNQRIQARPKGVAKAAPKKREFKIVKKS

SEQ ID NO: 30047 - protein, 117 aa, Streptococcus constellatus
MTKIYDFSIFDQNNRSISLEIYKGNVLLIVNTATGCGLTPQYKGLQHLYTRYQNQGFEILDFPCNQFMGQAPGTAEEINRFCSLHYQTTFPRFAKVKVNGKEADPLYIWLKEQQAGP

SEQ ID NO: 30048 - protein, 568 aa, Rickettsia akari
MSIKLKQRFVPQLAAINHKFEEDFSKMLETVDTSHIKEKTVVKGQVIEIKNDMIIVDVGLKNEGRIPKCEFLALPEVRDVVEVFIEKIEGRNGRTILSREKAVKEELWGQLEIMCSKGEFVDGTIFGRVKGGFTVDLSGVVAFLPGSQVDVRPIKDPTSIMNIKQPFKILSMDKKLGNIVVSRRAILEESRSEARDEMLAKIKEGMVLEGTVKNITDYGAFIDLGSVDGLLHLTDISWGRVNHPSEVLEFNQKVKVMVIKFDEKTKRISLGIKQLDSNPWEALKEEFPVGKKMIGKVTNFADYGVFIELKDGLEGLVHASEISWLKSNQHPRKTLTIGQEVEFVVLEVDTEKHRVSLSIKQCQENPLIKFAENNPVGTIIKAPIRNITDFGIFVALGNNMDGMIHEGDISWEDKGIDLLKSYKKGDEIECKVLSINIEKEQVSLGIKQLLPNPYHEISDEYKKGTIVKALITEVKDDGLEVLLNNKVAGFIKRTELSDEKDEQKPEMFKIDEAIEAKVVSIDKSTGRILLSVKAHKIAERQKALKEYGSSDNTTNIGDILANALEDKK

SEQ ID NO: 30049 - protein, 222 aa, Hordeum vulgare
MAGEKGLVLLDFWVSPFGQRVRIALAEKGLPYEYVEEDLIAGKSDRLLRSNPVHKKIPVLLHDGRPVNESLIILNYLDDAFPDAPALLPSDPYARAQARFWADYVDKKVYDCGTRLWKVKGEPQAQARAEMLEILKTLDGALGDKPFFGGDKFGFVDAAFAPFTAWFHSYERYGEFSLAEVAPKIAAWAKRCGERESVAKSLYSPEKVYDFIGLLKKRYGIE

SEQ ID NO: 30050 - protein, 493 aa, Glycine max
TQRFLSVQSWKTSRTSRNLRNSKPGSGIAHAVLTSDIDEDSMAFQGVPTFEKPEVDPKSVASIILGGGAGTRLFPLTGRRAKPAVPIGGCYRLIDIPMSNCINSGIRKIFILTQFNSFSLNRHLSRAYSFGNGMTFGDGFVEVLAATQTPGEAGKKWFQGTADAVRQFIWVFEDAKNKNVEHILILSGDHLYRMDYMDFVQRHVDTNADITVSCVPMDDSRASDYGLMKIDKTGRIIQFAEKPKGSDLKAMRVDTTLLGLLPQEAEKHPYIASMGVYVFRTETLLQLLRWKCSSCNDFGSEIIPSAVNEHNVQAYLFNDYWEDIGTIKSFFDANLALTEQPPKFEFYDPKTPFFTSPRFLPPTKVEKCKIVDAIISHGCFLRECSVQHSIVGVRSRLESGVELQDTMMMGADYYQTEYEIASLVAEGKVPIGVGANTKIRNCIIDKNAKIGRNVIIANTDGVQEADRAKEGFYIRSGITVTLKNATIKDGTVI

SEQ ID NO: 30051 - protein, 179 aa, Crocosphaera watsonii
MDAQISGQFHSTAEVIDISDKIFNSPVIGIKWQDARWFCAWLATRKDLQSSEEVYDYRLPTADEMLQSARKGITEDYEGIGDFLRVVRVTIPSYYQTLINYLSSGRWKDADEETVQVILQVANRVKQGWLDFKDIDNFPCEDLRIIDQLWVKYSNGQFGFSVQKQIYMDELGGTKMYNE

SEQ ID NO: 30052 - protein, 303 aa, Nostoc punctiforme
MARITTPFGRHSTASEVAQGIDLSGKRAIVTGAASGIGVETARALAHAGAEVTLAVHNVDAGAKTAADITAITGNQNIHVAKLDLTDRGAIAKFIAAWNEPLHILVNNAGVMALPEQHTPEGWEMQFATNHLGHFALTLGLHDALAADGAARIVSVSSSAHMLSPIVFDDIHFAFRPYDPWLAYGQSKTANVLFAVAGTGRWFRDGITANALMPGAIATNLQRHVGGIQTPAELQKTPEQGAATSILLATSPLVEGIGGRYFEDCNEATIVTQQTKDYSGVAPYALNTNNADRLWEESLRLLA

SEQ ID NO: 30053 - protein, 589 aa, Brassica napus
MSLPETKTQTLLDAWDFQGRPADRSKTGGWASAAMILCIEAVERLTTLGIGVNLVTYLTGTMHLGNATAANTVTNFLGTSFMLCLLGGFIADTFLGRYLTIAIFAAIQATGVSILTLSTIIPGLRPPRCDPTTSSHCVQANGIQLTVLYLALYLTALGTGGVKASVSGFGSDQFDDTEPKERSQMTYFFNRFFFCINVGSLMAVTVLVYIQDDVGRKWGYGICALAIVLSLSIFLAGTNRYRFKKLIGSPMTQVGTVLVAAWRNRRLELPSDPSFLYDLDDVIAAEGSMKSKQKLPHTNQFRSLDKAAIKDQEMAMTQNVYNKWTLSTVTDIEEVKQIVRMLPIWATCILFWTVHAQLTTLSVAQSETMDRHIGSFEIPPAAMAVFYIGGLLLTTAVYDRLAIPLCKKLFNYPHGLRPLQRIGLGLLLAAMGMAVAALVEIKRLRTAHAHGPTVKTLPLGFSLLIPQYLIVGIGEALIYTGQLDFFLRECPKGMKTMSTGLLLSTLALGFFFSSVLVTIVEKVTDKAHPWIADDLNKGRLYNFYWLVAVIVALNFLVFLVFSKWYVYKEKRLADLGIELEDEPDIPMGH

SEQ ID NO: 30054 - protein, 481 aa, Hordeum vulgare
ALAAKAGVVGAGRTTAPPAVPGLPLIGNLHQLKEKKPHKTFAKWSDIYGPIYTIKTGASSVAVLNSSEVAKEAMVAKYSSISTRKLPKALSVLTRDKTMVATSDYGDFHKMVKRLVMSGMLGSSAQRQFRDTRDMMMDNMLSTFHTLVTDDPHSPLNFREVFKDELFRLSLIQSLGEDVDSVYVKEFGREISKDEIYQITVVDMMMCAIDVDWRDFFPYLSWIPNKSFETRVHTAESRRTAVMQALIRQQKKRIANGEARASYLDFLLAEKALTDEQLMMLVWEAVIEAADTTLVTTEWAMYELAKNPEKQDRLYQEIREVCGDETVTEDHVPRLPYLSAVFHETLRLHSPVPLVPPRFVHETTKLAGYDVPAGTEIVINLYGCNMNKKDWEEPEEWRPERFMDGRFEAADMYKTMAFGAGRRSCAGSLQATSISCAAIARFVQDFAWRLKEGDEDNVDTVQLTSYKLHPLYVYLLPRGRK

SEQ ID NO: 30055 - protein, 404 aa, Mycobacterium avium
MREAPHVLGIVLAGGEGKRLYPLTADRAKPAVPFGGAYRLIDFVLSNLVNARYLRICVLTQYKSHSLDRHISQNWRLSGLAGEYITPVPAQQRLGPRWYTGSADAIYQSLNLIYDEDPDYIVVFGADHVYRMDPEQMVRLHIDSGAGATVAGIRVPRSEATAFGCIDSDESGRIRKFVEKPLDPPGTPDDPETTFVSMGNYIFTTKVLIDAIRADADDDHSDHDMGGDIIPRLVDDGMAAVYDFSDNEVPGATDRDRGYWRDVGTLDAFYDAHMDLVSVHPVFNLYNKRWPIRGESENLAPAKFVNGGSAQESVVGAGSIISAASVRNSVLSSNVVVDDGAIVEGSVIMPGARVGRGAVVRHAILDKNVVVGPGEMVGVDLERDRERFAISAGGVVAVGKGVWI

SEQ ID NO: 30056 - protein, 164 aa, Francisella tularensis
MRSFLSRLRWHCHFMQKLEDQPSIEYENLHSAYDQLRTELLNQQCFEAWKTGNTGYPMIDACMRALIATRWLNFRMRAMLMSFASYHLWLDWRVTSLYLAGLFTDYEPGIHYSQVQMQSGTTGINSIRIYNPIKQSIDQYPNVEFIRRWLPELENVSNENIHTP

SEQ ID NO: 30057 - protein, 638 aa, Streptomyces verticillus
MRPVCGIVAIRSADGGLDGGELTAPMADLRPRGPDGEGTWVSPTGRAALGHTRLAVIAPDAGRQPVAGPDGTVRLVVNGEFYGYREIRAELRAAGCRFRTGSDSEIALHLYLRDGRRALERLRGEFAFVLWDERRATLFAARDRFGVKPLYYTERDGRLYVASTVRALLSCGAPARWDTAAFAAHLQLGLPPDRTLFAGIRQLPPGCHLIADAHGTRVTPYWDLDYPPAGELAARGSLDDHLDAVRERTDEAVRLRTVADVPLACHLSGGLDSSAVAASAARHTRLTAFTVRFDDPAFDESAVARRTAAHLAIDHREVASERAHFADHLRDVVRAGEMVQENSHGIARYLHSAHIKKAGFTAVLAGEGGDELFLGYPQFRKDLTLSLSADARDKADRGYARLVAAGLLPPYLRTLLGTLGFLPSWIVDRHLAVTQPVAALLRPDFAAELARADAAAPLLAAGAGLLAGRAPAHQATYLFAKTWLPGYLLAAERLDAAQAVEVRLPLFDHHLFDLVRHTPPAWYDKDGTGKYPLRAAMRHRLPREVTEGRKQGFLAPPMADDDTLLDALRERLAGPGAGDDPFFDPHAVRALLDRLAAAPPGQRSGGEKLLQLVASTAELADEFGLTTAPSGQKGGNGG

SEQ ID NO: 30058 - protein, 443 aa, Arabidopsis thaliana
MASGVFEDEAEGTITINEYIERLDAEELAADLVLGGDEGDECTFPKGYMKRQAIFSCITCTPEGNAGICTACCLSCHDGHELLELWTKRNFRCDCGNSKFGTLACKLLPSKDIENSENSYNHNFKGLYCTCDRPYPDPNVEEQVEMIQCCLCEDWFHEEHLGLTPSDSVGSQIPRDEESEPIYEDFICQNCSPACSFLTLYPENLWVVAKVDSTGSANACSETIELDKNHMDSEPGQPENGTDAEKSVVGKCSETISDSEPGQPENGTEAEKSVVQKCSEKIDESEAGQPENSTEAEKFVVRKCSEKIDGSENVPAAGCVIRTDLNSCPEFEKKPLFLTKNWRNILCRCEKCLEMYKQRKVSYLLDAEDTIVEYEKKAKEKRTEKLEKQEGEALDLLNNLDHVSKVELLHGIKDFQDGLQGLMVYIVTIYERNLITILRNHFI

SEQ ID NO: 30059 - protein, 382 aa, Bacillus cereus
MVEKMNEEVMDSKELQVGDVVTGSVTKVEEKQVLVNVGYKTDGVIPISELANVHIEKASDVVELDQTLELKIIKLEEDDLVLSKRAVDAEKAWVELQEKFTSGHVFDVIVKDIVNGGLVVDLGVRGFIPASLVEVHYVEDFTDYKGKTLAVKIVELDREKNRVILSHKAVVELELDSKKKEAISSLKEGDVVEGTVQRLTDFGAFVNVGGVDGLVHISQISHERVEQPSEVLEQGQKVKVKVLSVDADTQRISLSIKAAQPGPWENVAGEIKAGDIREGVVKRLVTFGAFVEILPGVEGLVHVSQIANRHVKNPNEVLEMGQEVKVKVLEVHVAEKRISLSIKEALEENNVTEDYSQYEPNADSATFQLSDIIGEQLKKLKK

SEQ ID NO: 30060 - protein, 203 aa, Triticum aestivum
QVAMAARRSGAVVAALMALLVGLAGADFAADRAECADKLMGLATCLTYVQLAATARSPTPDCCSGFRQVLGVSKKCLCVLVKDRDEPTLGIKFNVTRAMNLPSACNIPATFSDCPKILNMSPDSKEAEIFKQYGIEHEGKNATAGGSAAVTGTSGGKSADANGPGAGKAPRGVGPSPVLPFLGALLAPPFLCVPPLDRPGFAF

SEQ ID NO: 30061 - protein, 197 aa, Chromobacterium violaceum
MRTATVTRNTLETQITVSLNLDGTGVGRFETGVPFLDHMMDQIARHGLIDLDVKAVGDLHIDAHHTVEDIGITLGQAFAKAIGDKKGIRRYGHAYVPLDEALSRVVIDLSGRPGLVYNVDYTRACIGQFDVDLFSEFFHGFVNHSMVTLHIDNLRGHNSHHQAETIFKAFGRALRMACEHDERMAGITPSTKGTLSV

SEQ ID NO: 30062 - protein, 328 aa, Prochlorococcus marinus
MAKIYEDNSFAIGNTPLVKLKSVTKNAKATVLAKIEGRNPAYSVKCRIGANMIWDAEKSGKLTKDKTIVEPTSGNTGIALAFTASARGYKLVLTMPESMSIERRRVMAVLGAEIVLTEASKGMPGAIAKAKEIAESNPSKYFMPGQFDNPANPEIHFKTTGPEIWDDCDGEIDVFVAGVGTGGTITGVSRYIKQEKGKNIVSVAVEPSHSPVITQTMNGEEVKSGPHKIQGIGAGFIPKNLDLSIVDKVEQVTNDESIEMALRLAKEEGLLVGISCGAAAAAAVRLAEQDEYAGKTIVVVLPDLAERYLSSIMFTEVPNGIIEEPVKA

SEQ ID NO: 30063 - protein, 1025 aa, Ralstonia metallidurans
MTPLTRKRANNGANDGANHRADHGQTGRLTSRLADSSSQSQSQSQSSGRLSARLAAGLAGAMPTMDRRSFLKRSGIGVGAGLAATQLTMMRRADADDGKGGAGGKGDIVVRRTVCGHCSVGCAVDAVVQNGVWVRQEPVFDSPINLGAHCAKGAALREHGHGEYRLKYPMKLVNGKYQRISWDQALDEISAKLKQIRQETGPDSLFFIGSSKHSNEQSYLLRKWVSFFGTNNTDHQARICHSTTVAGVANTWGYGAMTNSYNDMQNAKAALYIGSNAAEAHPVSMLHLLHAKESGCKVIVVDPRYTRTAAKSDHYVRIRSGTDIAFLFGVLYHIFQNGWEDKKYLSDRVYGMDKVKEEVLAKWTPDKVEEVCGVPEAEVRYVAETMAKNRPSTLVWCMGQTQHTIGNAIVRASCIVQLALGNIGVSGGGANIFRGHDNVQGATDVGPNPDSLPGYYGLAAGAWKHFAAVWGVDYEWIKKQFASQAMMEKSGTTVSRWIDIVTEKPELIDQDHNVRGVFFWGHAPNSQTRGLEMKRALDKLDLLVVIDPYPSATAAMANMPATEGDTPNPNRAVYLLPACTQFETSGSCTASNRSLQWREKVIEPLFESMPDHAIMQAFAEKLGFANELSKNYKLVEVKRAGRTWREPETESILREINAGNWTIGYTGQSPERLKAHMRNMHMFDVRSLRCKGGKDPVTGYDITGDYFGLPWPCYGTPELKHPGSPNLYDTSRNVMDGGGNFRANFGVERDGVSLLAADGSHSLGADITTGYPEFDAVLLKKLGWWDELTDAEKKAADGKNWKTDLSGGIQRVVMKNHGCHPFGNARARAVVWNFPDPIPQHREPLYSTRPDMVAKYPTHDDKMAFWRLPTLYKTVQQRNIENKVYEKFPIILTSGRLVEYEGGGEETRSNPWLAELQQENFVEINPKAASERGIRNGDYCWVKTPTGARIKVRALVTERVGVDTAFIPFHFSGWWQGKDLKPYYPEGAMPIVRGEAVNTATTYGYDSVTMMQETKTTVCQIERFA

SEQ ID NO: 30064 - protein, 358 aa, Thermotoga maritima
MKVVIVGNGPGGVELAKQLSEEHEVTIVERETVPYYTKPMLSHYVAGLAEEKSLFPYPIDWYEKKGIKLLLGTTAKRIDAEKKVLETDRGTLEYDVLVLATGAKPRTLKIPGWERMYTLRTIEDAKRLKGAVEREKDLLIIGGGFIGLEIAGNLSKQGIKVKVVEKMTRLMGLDEELTERIKGELEKHGVEFYLGRDVERIENDVLVTDKEEIPARVILCSIGIVPEVSLAKESGLDVNRGILVDKTFRTSKPDIYAIGDCAEHEGIICGTAKAAMAHAKVLANTLKGIPDEYDFHFRSSYFKFGDFPIAIVGELTDRGEWIDSETKSFYRDEKIVGVVVLSDVRKAREWEERLRSTR

SEQ ID NO: 30065 - protein, 198 aa, Brassica napus
LRMQKGLVPTKFFADMLRIAKILKASPSCVANLEKRIGMQLDQAALEDLVMPSFSHTMETLYDVDSVQRILDHFLSTDQIMPADVGSPCSSVDDGNVIGSPRLITPMTAVAKLIDGYLAEVAPDVNLKLPKFQALAASVPEYARLLDDGLYRAIDIYLKHHPWLAETERENLCRLLDCQKLSLEACTHAAQNERLPLR

SEQ ID NO: 30066 - protein, 430 aa, Robiginitalea biformata
MVIKEPKSKKPVKQGMLDNVMRQFDHAADLLELNPNIRKILEVTNNELLVHFPVRMDDGTVKIFTGYRVQHNNALGPYKGGLRYHPTVDIDAAKALAMWMTWKTSLAGLPFGGAKGGIQLDPSRYSQEELQRITRRFTFALGDNIGPELDIPAPDVNTTAQTMAWILDTYMSTKSPAERSTNLHVVTGKPIGAGGSAGRDRATGYGVYLTIKFWAETRGHTLHGKTFAVQGFGNVGYWASHFLEEEGGVLIGVQDASGTLYRAEGIDVGELAEYARANRGRIHGFSKASPIDSGDFFGLDCDILIPAALGNQITAKNAPDIKASLIAEGANGPTDVSAEAILLEKQVDIIPDILCNSGGVIGSYFEWLQNKNSEIWPMEEVMDRLEKKMRESFNRVTAEAEERQVDWRSAAFIIAIERLADAYTQRGIFP

SEQ ID NO: 30067 - protein, 398 aa, Thermotoga maritima
MPKIWTERIFDDPEIYVLRIDDDRIRYFEAVWEIPEGISYNAYLVKLNGANVLIDGWKGNYAKEFIDALSKIVDPKEITHIIVNHTEPDHSGSLPATLKTIGHDVEIIASNFGKRLLEGFYGIKDVTVVKDGEEREIGGKKFKFVMTPWLHWPDTMVTYLDGILFSCDVGGGYLLPEILDDSNESVVERYLPHVTKYIVTVIGHYKNYILEGAEKLSSLKIKALLPGHGLIWKKDPQRLLNHYVSVAKGDPKKGKVTVIYDSMYGFVENVMKKAIDSLKEKGFTPVVYKFSDEERPAISEILKDIPDSEALIFGVSTYEAEIHPLMRFTLLEIIDKANYEKPVLVFGVHGWAPSAERTAGELLKETKFRILSFTEIKGSNMDERKIEEAISLLKKELE

SEQ ID NO: 30068 - protein, 466 aa, Vibrio vulnificus
MTYAPVKDVLSGKLAVDSEVTVRGWIRTRRDSKAGISFLAIYDGSCFDPIQAVVPNNLNNYNDEVLKLTTGCSVEVTGKIVASPAAGQAFELAATDVKVVGWVEDADTYPMAKTRHSIEYLREVAHLRPRTNVIGAVARVRHSLSQAIHRFYHEQGYYWLSAPLITASDCEGAGEMFRVSTLDLANLPRTESGDVDFNEDFFGKETFLTVSGQLNGEAYACALSKIYTFGPTFRAENSNTSRHLAEFWMVEPEVAFADLNDIAKLAEDMLKYVFAAVLEERRDDLEFFASRIDKDVINRLEQFVSSDFAQVDYTDAIQILLDSGREFEFPVEWGIDMSSEHERFLAEEHFKAPVIVKNYPKDIKAFYMRMNEDGKTVAAMDVLAPGIGEIIGGSQREERLDVLDARMVEMGIDPEHMNWYRDLRRYGTVPHAGFGLGFERLVSYVTGMGNVRDVIPFPRTPRNANF

SEQ ID NO: 30069 - protein, 489 aa, Corynebacterium ammoniagenes
MPTSNTPQVAINDIGTAEDFLAAVDATIKYFNDGDIVEGTVVKVDHDEVLLDIGYKTEGVIPSRELSIKHDVDPDEVVEVGDQIDALVLTKEDKEGRLILSKKRAQYERAWGAIEELQAKEEPVTGTVIEVVKGGLIIDIGLRGFLPASLVEMRRVRDLEPYIGQELEAKIIELDKQRNNVVLSRRAFLEQTQSEVRSEFLHQLQKGQVRKGVVSSIVNFGAFVDLGGVDGLVHVSELSWKHIDHPSEVVTVGDEVTVEVLDVDLDRERVSLSLKATQEDPWRVFARTHAVGQIVPGKVTKLVPFGAFVRVEEGIEGLVHISELAQRHVEVPDQVVNVGEDVMVKVIDIDLERRRISLSVKQADEDYTEEFDPSKYGMADSYDEQGNYVFPEGFDSETNEWKEGFDEQRQAWEARYAESERRFQLHTAQIERHRAAAAEAAETEAASANYSSESNDAAPASEAPAESAGSLASDEQLAALREKLAGGEN

SEQ ID NO: 30070 - protein, 350 aa, Oryza sativa
MAVVHRILRRGLSAASPLPSLRGLLLVSPQEPGRRPASSSAAEAAAGDVEAELRAAREDVRQLLKSNPCHPILVRLGWHDAGTYDKNITEWPKCGGANGSLRFGVELVHAANKGLLKALFLVIPIKSKYAGVTYADIFQLASATAIEEAGGPKIPMIYGRADVADGEECPPEGRLPAADPPSPAEHLREVFYRMGLSDKEIVALSGAHTLGRARPERSGWGKPETKYTENGPGAPGGQSWTSEWLKFDNSYFKEIKERRDEDLLVLPTDAVLFEDSSFKIHAEKYAEDQDAFFEDYAEAHAKLSNLGAKFDPPKVNEIKDFLTSIIGMEKMSSQLDLLIIAEMAQGISLE

SEQ ID NO: 30071 - protein, 852 aa, Streptococcus thermophilus
MNTTEKIQTYLNDPKIVSVNTVDAHSDHKYFESLAEFSEGEMKLRQSLNGKWKIHYAQNTNQVLKDFYKTEFDETDLNFINVPGHLELQGFGSPQYVNTQYPWDGKEFLRPPQVPQESNAVASYVKHFTLNDALKDKKVFISFQGVATSIFVWVNGNFVGYSEDSFTPSEFEISDYLVEGDNKLAVAVYRYSTASWLEDQDFWRLYGIFRDVYLYAIPKVHVQDLFVKGDYDYQTKAGQLDIDLKTVGDYEDKKIKYVLSDYEGIVTEGDASVNGDGELSVSLENLKIKPWSAESPKLYNLILHVLDDDQVVEVVPVKVGFRRFEIKDKLMLLNGKRIVFKGVNRHEFNARTGRCITEEDMLWDIKVMKQHNINAVRTSHYPNQTRWYELCDEYGLYVIDEANLETHGTWQKLGLCEPSWNIPASEPEWLPACLDRANNMFQRDKNHASVIIWSCGNESYAGKDIADMADYFRSVDNTRPVHYEGVAWCREFDYITDIESRMYAKPADIEEYLTTGKLVDLSRVSDKHFASGNLTNNPQKPYISCEYMHTMGNSGGGLELYTDLEKYPEYQGGFIWDFIDQAIYKTLPNGSEFLSYGGDWHDRPSDYEFCGNGIVFADRTLTPKLQTVKHLYSNIKIAVDEKSVTIKNDNVFEDLSAYTFLARVYEDGRKVSESEYHFDVKPGEEATFPVNFVVEASNSEQIYEVACVLREATEWAPKGHEIVRGQYVVEKISTETPVKAPLNVVEGDFNIGIQGQNFSILLSRAQNTLVSAKYNGVEFIEKGPKLSFTRAYTDNDRGAGYPFEMAGWKVAGNYSKVTDTQIQIEDDSVKVTYVHELPGLSDVEVKVTYQVD

SEQ ID NO: 30072 - protein, 303 aa, Escherichia coli
MSTLEQTIGNTPLVKLQRMGPNNGSEVWLKLEGNNPAGSVKDRAALSMIVEAEKRGEIKPGDVLIEATSGNTGIALAMIAALKGYRMKLLMPDNMSQERRAAMRAYGAELILVTKEQGMEGARDLALEMADRGEGKLLDQFNNPDNPYAHYTTTGPEIWQQTGGRITYFVSSMGTTGTITGVSRFMREQSKPVTIVGLQPEEGSSIPGIRRWPAEYLPGIFNASLVDEVLDIHQRDAENTMRELAVREGIFCGVSSGGAVAGALRVAKANPGAVVVAIICDRGDRYLSTGVFGEEHFSQGAGI

SEQ ID NO: 30073 - protein, 457 aa, Escherichia coli
MDHLPIFCQLRDRDCLIVGGGDVAEPKARLLLDAGARLTVNALAFIPQFTAWADAGMLTLVEGPFDESLLDTCWLAIAATDDDALNQRVRQAAEARRIFCNVVDAPKAASFIMPSIIDRSPLMVAVSSGGTSPVLARLLREKLESLLPLHLGQVAKYAGQLRGRVKQQFATMGERRRFWEKLFVNDRLAQSLANNDQKAITETTEQLINEPLDHRGEVVLVGAGPGDAGLLTLKGLQQIQQADVVVYDRLVSDDIMNLVRRDADRVFVGKRAGYHCVPQEEINQILLREAQKGKRVVRLKGGDPFIFGRGGEELETLCNAGIPFSVVPGITAASGCSAYSGIPLTHRDYAQSVRLITGHLKTGGELDWENLAAEKQTLVFYMGLNQAATIQQKLIEHGMPGEMPVAIVENGTAVTQRVIDGTLTQLGELAQQMNSPSLIIIGRVVGLRDKLNWFSNH

SEQ ID NO: 30074 - protein, 467 aa, Triticum aestivum
MGRRSGGRKLPFFSAASSSSSTKRTRSARRLPSLPKPSSPPPPSPTTPPPAPQTTTSPPAPSPGGSAAVAGVSGKVGKKKAGARLWMRLDRWGSSEILELDKASIIRRAGVPPRDLRILGPVFSHSSSILAREKAMVINLEFIRAIVTAEEVLLLDPLMQEVLPFVDQLRQHLPLRSLVGGNGEHGGDSNGVKQDGSPGDQVPCLNEATGAEHELPFEFQVLEVGLEAVCSTLDSSVADLERRAIPVLDELTKNVSTKNLERVRSLKSDLTRLLARVQKVRDEIEHLLDDNEDMAHLYLTRKQAQNQQVEAIMTSAASNSIVPAGASLPRLNSSFRRSVSIATSIYLDNDVEDLEMLLEAYFMQLDGIRNRILSVREYIDDTEDYVNIQLDNQRNELIQLQLTLTIASFGIAVNTFIAGAFAMNIPCHFYDTDGSFFWPFVGGTSSGCFVISVVLLGYAWWKKLLGP

SEQ ID NO: 30075 - protein, 852 aa, Streptococcus thermophilus
MNMTEKIQTYLNDPKIVSVNTVDAHSDHKYFESLAEFSEGEMKLRQSLNGKWKIHYAQNTNQVLKDFYKTEFDETDLNFINVPGHLELQGFGSPQYVNTQYPWDGKEFLRPPQVPQESNAVASYVKHFTLNDALKDKKVFISFQGVATSIFVWVNGNFVGYSEDSFTPSEFEISDYLVEGDNKLAVAVYRYSTASWLEDQDFWRLYGIFRDVYLYAIPKVHVQDLFVKGDYDYQTKTGQLDIDLKTVGDYEDKKIKYVLSDYEGIVTEGDASVNGDGELSVSLENLKIKPWSAESPKLYDLILHVLDDDQVVEVVPVKVGFRRFEIKDKLMLLNGKRIIFKGVNRHEFNARTGRCITEEDMLWDIKVMKQHNINAVRTSHYPNQTRWYELCDEYGLYVIDEANLETHGTWQKLGLCEPSWNIPASEPEWLPACLDRANNMFQRDKNHASVIIWSCGNESYAGKDIADMADYFRSVDNTRPVHYEGVAWCREFDYITDIESRMYAKPADIEEYLTTGKLVDLSSVSDKHFASGNLTNKPQKPYISCEYMHTMGNSGGGLQLYTDLEKYPEYQGGFIWDFIDQAIYKTLPNGSEFLSYGGDWHDRPSDYEFCGNGIVFADRTLTPKLQTVKHLYSNIKIAVDEKSVTIKNDNLFEDLSAYTFLARVYEDGRKVSESEYHFDVKPGEEATFPVNFVVEASNSEQIYEVACVLREATEWAPKGHEIVRGQYVVEKISTETPVKAPLNVVEGDFNIGIQGQNFSILLSRAQNTLVSAKYNGVEFIEKGPKLSFTRAYTDNDRGAGYPFEMAGWKVAGNYSKVTDTQIQIEDDSVKVTYVHELPGLSDVEVKVTYQVD

SEQ ID NO: 30076 - protein, 277 aa, Solanum lycopersicum
MALQAAALLPSTFSIPKEGKTSASLKDSSLFGISLSDHVKSDFGSSFKIKSGRKSSLGAIRAETMVASPGVTSTPVTGKKTLRKGCVVITGASSGLGLATAKALAETGKWHVIMACRDFLKAERAAKSAGMPKENYTIMHLDLASLDSVRQFVDNFRRSGNPLDVLVCNAAVYQPTAKEPSFTAEGFELSVGTNHLGHFLLSRLLIDDLKQSDYPSKRLIIVGSITGNTNTLAGNVPPKANLGDLRGLARGLDGLNSSAMIDGGDFDGAKAYEDSKV

SEQ ID NO: 30077 - protein, 794 aa, Magnetospirillum magnetotacticum
MQNLSSVSKATRACQITLGLCAAFALVALLLQNWVAAGFAVVTAVSAWMPLGYLSRTHVSVEKAVKVCQAAASGNLGVRIMDIRGTGNLALMLRSINRLLDLTEAYCRESQAAMEHANQRQYFRKIIQTGLRGDFARYAGVINASLDLMKSRDAEALTFAEQNVRILVQEVSSASTQLRQSSDRLMNNATQTVEQAMTSAAAAEEASVNVQSVAGAAEELAASFGEINMQTTRATAISSEAMVTAQRTDETVRDLGTAAEKIGSVLSLIQDIASQTNLLALNATIEAARAGEAGKGFAVVANEVKTLANQTARATEEISAHVSQIQLASQGAAVAIREIAQIVGTIQETSTAVAGAVEEQNAVTMEISRNVQEAATGTASVSEAVAYVKDTAETPTKRPATSPPPPPVWRRAPTTWKPRSAASSPRSRGRPPEFRAVGEPGIRLSRLLPPPRRGKPGDGFGGGFMKKIGVIGGGAWGTALALTARRAGRDVVLWAREPQVVDDVNTRHVNSDFLPGVDLDPALRATADLAEAADADAVLLVSPAQHLRAACRALAPHWRSGVPAVICAKGIELATCALMQDAVAAELPQAPIAVLSGPTFAIEVARGLPTAITLACGDAALGRKLVDALGTATFRPYLSDDLVGAQVGGAVKNVLAIACGIVEGRGLGDNARAALITRGLAELTRLAMAKGGRPETLMGLSGLGDLILTASSTQSRNYSLGFALGEGRALADILGERHSVTEGVYSAGAVVDMAGRTGVEMPISAAVDAVINGGQSLDEAIRALLSRPFRNEGL

SEQ ID NO: 30078 - protein, 264 aa, Apium graveolens [sequence omitted]

SEQ ID NO: 30079 - protein, 199 aa, Fusobacterium nucleatum
MGNLKNHLMKYERRPIMKIYDFKVKNRKGEDISLENYKGKVLLIVNTATRCGFTPQYDELEALYSKYNKDGFEVLDFPCNQFGNQAPESNEEIHTFCQLNYKVKFDQFAKVEVNGENAIPLFKYLKEEKGFAGFDSKHKLTSVLTEMLSKNDPDFAKKSDIKWNFTKFLVDKSGNVVARFEPTTSAEVIEQEIKKLLEV

SEQ ID NO: 30080 - protein, 151 aa, Lactococcus lactis
MSYISKIREKIGHELLIYLGAGVIVYSDEKILLQKRKDNGTWALHAGGIEVGEELEETARRELFEETGLKAGKLELLGIYSGQDRFITYPNMDQVYMPGLYYICRDFTGSLRPQMSEVEELKWFKFKEIPKNIHEPNRRVIEDFIQLIAKE

SEQ ID NO: 30081 - protein, 852 aa, Streptococcus thermophilus
MNTTEKIQTYLNDPKIVSVNTVDAHSDHKYFESLAEFSEGEMKLRQSLNGKWKIHYAQNTNQVLKDFYKTEFDETDLNFINVPGHLELQGFGSPQYVNTQYPWDGKEFLRPPQVPQESNAVASYVKHFTLNDALKDKKVFISFQGVATSIFVWVNGNFVGYSEDSFTPSEFEISDYLVEGDNKLAVAVYRYSTASWLEDQDFWRLYGVFRDVYLYAIPKVHVQDLFVKGDYDYQTKAGQLDIDLKTVGDYEDKKIKYVLSDYEGIVTEGDASVNGDGELSVSLENLKIKPWSAESPKLYNLILHVLDDDQVVEVVPVKVGFRRFEIKDKLMLLNGKRIVFKGVNRHEFNARTGRCITEEDMLWDIKVMKQHNINAVRTSHYPNQTRWYELCDEYGLYVIDEANLETHGTWQKLGLCEPSWNIPASEPEWLPACLDRANNMFQRDKNHASVIIWSCGNESYAGKDIADMADYFRSVDNTRPVHYEGVAWCREFDYITDIESRMYAKPADIEEYLTTGKLVDLSRVSDKHFASGNLTNKPQKPYISCEYMHTMGNSGGGLELYTDLEKYPEYQGGFIWDFIDQAIYKTLPNGSEFLSYGGDWHDRPSDYEFCGNGIVFADRTLTPKLQTVKHLYSNIKIAVDEKSVTIKNDNVFEDLSAYTFLARVYENGRKVSESEYHFDVKPGEEATFPVNFVVESSNSEQIYEVACVLREATEWAPKGHEIVRGQYVVEKISTETPVKAPLNVVEGDFNIGIQGQNFSILLSRAQNTLVSAKYNGVEFIEKGPKLNFTRAYTDNDRGAGYPFEMAGWKVAGNYSKVTDTQIQIEDDSVKVTYVHELPGLSDVEVKVTYQVD

SEQ ID NO: 30082 - protein, 161 aa, Solanum lycopersicum
RDFLKAEKAAKSVGMSKENYTIMHLDLASLDSVRQFVDNFRRSGRPLDVLVANAAVYQPTAKEPSFTAEGFELSVGTNHLGHFLLSRLLLDDLKQSDYPSKRLIIVGSITGNTNTLAGNVPPKANLGDLRGMAGGLNGINSSAMIDGGEFDGAKAYKDSKV

SEQ ID NO: 30083 - protein, 445 aa, Unknown
  Synechococcus sp. RS9917
MIIGGSDAGISAAIRIRELDTNAEVSVLLRDAYPNYSICGLPFLISGQTAMPEQLAHRSLSELERLGLQIQAHTTAVAVDASRQTVETHKGHRIPYDRLILATGARARRPQLAGVDEEGVFSLRWMGDALRLQSFLLEQQPRHAVIVGGGYIGLEMADALHRRGLQLAVVEHNTALLRTVHASLASSLQQALLQRGHSLHLNQRLRAIHRQGRALAAELSDGSMIHTEMVLLAVGAVPATELAASAGIALGAGGAMVVDRQMRTGVDQIWAAGDGVETYHRLLQRHGYQPLGTNAHKQGRIAGENALGGSRHYAGTLGSQVVQVFDQVVARTGLRSSEAEAAGWQARSAAFKCWSHKAYVPGAGSLHFRITGDDRSGRLLGAQMVGPAGAEVAKRLDTFAQALFHELTIEAISDLDLCYTPPLSSPWDPVQMAAQHWCLQRNAAA

SEQ ID NO: 30084 - protein, 148 aa, Arabidopsis thaliana
  misc_feature (35)..(35): Xaa can be any naturally occurring amino acid
  misc_feature (51)..(51): Xaa can be any naturally occurring amino acid
  misc_feature (103)..(103): Xaa can be any naturally occurring amino acid
KIIDSRPKSFPWETRLKISIGAAQCLAFLHSKNQXGLYPRYLTALKILLHXDFNARVSYFGKPKVSLDELVNPLGFSNVAPRNQNPPPENKLSGMSNMAGDVXSFGVKPLKMLTGLGKALPISAKRKKKKKKKKKKKKKKKRAAVLDR

SEQ ID NO: 30085 - protein, 249 aa, Carboxydothermus hydrogenoformans
MGELTGKVGIVTGGSKGIGFATAKRIAEEGAKVVIANRNKEEGEKAALQLREKGLEVYSIPCDVGKVADIKKLVSEVYGRYGRIDILVNCAGVNVRKPIEEYTEEDWNYMVDINLKGTFFACIEAGKHMIAQKEGVIVNLASIQAEEVLPERGIYATTKGGVKQLTKALAVEWAKYNIRVNAVSPAFIKTEMVEKVLQDPYWGNLIINKTPMRRPGTPEEVAEAILFLVSPKASYITGINLLVDGGWTA

SEQ ID NO: 30086 - protein, 295 aa, Rickettsia akari
MSNISSVNIKELLDAGVHFGHKTSRWNPKMASYIYGERDDVHIIDLRQSAALMSVALNAIYETVKKDGKVLFVSTKIQASDIIAEYAEKCGQYYVNHRWLGGMLTNWKTIAGSIEKLNKLEKTLENAEALIGYTKKEILDMSRKKEKLLLSLAGIRNLNSKPDLLVVIDTNKEHIAINEAVKLNVPIVAVVDTNSNPDNVDYPIPGNDDSIRSIRLYCRLFADAALQGLEESMKASGVDMGAMHEHTDNALISKNVSKLKQAKKFSKTKNIDEETNTEFEQALNDTDENKNADNA

SEQ ID NO: 30087 - protein, 674 aa, Musa acuminata
MTVICVAIFHKCNHGLNLKLIFCFCVKNLLLTEVIILLTKFDKTLTDILTNYLICCGFITVFLFRFCTTGLPSDVTVEVGEMTFHLHKFPLLSKCGLLEKLIRQKSEEGEDGCVIQLPDIPGGPKAFEPAAKFCYGMKMELTASNVVYLRCAAEHLEMTEEIAEGNLITQTEVFLNQVVLRSWKDSIKALQTCDYVLPYAEDLQIVKRCIDYLAIKACKDPSLVGWPIVEHGPMQSPGGSILWNGISTGARPRYSSSDWWYEDVSCLSLPMYRRLISAMETRGIGQEIISGSLTFYARRHLPGLDRRQSISEANIRLESRALMALPSEEEQRHLLEEIDKLLPSQKGLMSTKILFGLLRTAMILRASPSCMFNLERRIGMQLDQASLEDLLIPNFSDSTETLYNVDCIHRIVEHFVARNQMIGGASPDVADDDQFLGSPSLIPVIAVAKLVDGYLAEVASDANLKPSKFQALAAAIPDDVRPLDDGLYRAIDIYLKAHSWLAESQREELCRLMNCQKLSLEACTHAAQNERLPLRVVVQVLFFEQLQLKTSIAGCFLVSDNLDGSRPLRSGLPISGEDTGWASAIRENQVLKVSMDSMRMRVSELEKECSSMREELEKLTKGRSGWSTGGRKFRSNIIKGQICSAQEDAISKERDTVQTFEKEQLKLTKYKKHM

SEQ ID NO: 30088 - protein, 340 aa, Bacillus cereus
MTKITVVGAGSWGTALAMVLADNGHDVRIWGNRPELMDEINTKHENSRYLPGITLPSTIVAYSSLEEALVDVNTVLLVVPTKAYRDVLQEMKEIVTEPITWIHASKGIEPGTSKRISEVIEEEIPEHLIKDVVVLSGPSHAEEVGLRQATTVTSAAKRMEAAEEVQDLFMNSYFRVYTNPDIVGVELGGALKNIIALAAGITDGLGLGDNAKAALMTRGLTEIARLGRKMGGNPLTFAGLTGMGDLIVTCTSVHSRNWRAGNMLGKGHSLEEVLESMGMVVEGVRTTKAAHELAEKMEVEMPITAALYDVLFNGNNVKDAVGSLMGRVRKHEVEAIPDLL

SEQ ID NO: 30089 - protein, 100 aa, Triticum aestivum
  misc_feature (41)..(41): Xaa can be any naturally occurring amino acid
  misc_feature (53)..(53): Xaa can be any naturally occurring amino acid
  misc_feature (72)..(72): Xaa can be any naturally occurring amino acid
  misc_feature (77)..(77): Xaa can be any naturally occurring amino acid
  misc_feature (81)..(81): Xaa can be any naturally occurring amino acid
  misc_feature (84)..(84): Xaa can be any naturally occurring amino acid
  misc_feature (86)..(86): Xaa can be any naturally occurring amino acid
  misc_feature (90)..(90): Xaa can be any naturally occurring amino acid
APPRRGAALLVKAKKETFSTFEELLEKSEKPLLVDFYATWXVGPCQYMVPILXEVHGEDEVTRLTLVKIDTXEKYTXIANXLRXEXLPTXITSKGGLCPF

SEQ ID NO: 30090 - protein, 448 aa, Zea mays
MKDLAGLGHLFVVSFLFHFASFMVIPAVTDVTMEAACPGRDECSVAIYLSGFQNAVTGMGALVVTPIVGNLSDRYGRKALMTLPVTVAIAPLFILACGRSEVYFYVYYVAKIIAGVFCEGTMHCLCLAYVADHVGPRRRAAAFGLLSGVSAAGFVSGTLTARFLPTASTFQVAAAVAVAAALYLRAFLPDAGGSVSCADEACDPLLQDSSCASSTSSSDEELSPRLPPHKRGLPSLSDMVALLTGSLALSGAATITFFYSLGEHGLQTALLYYLKAQFGYNKDEFANLLLIVGAAGMLSQLTVMPILAPILGEEMLLIVGLLGGCTHVFLYGIAWSYWVPYFAAAFVILSAFVHPSIRTNVSKNVGSNEQGIAQGCISGISSFASILGPLIFTPLTAWFLSETEPFNFKGFSILCAGFCTLIAFVISLRMPGARSSTCKKTAVQHEQA

SEQ ID NO: 30091 - protein, 128 aa, Narcissus pseudonarcissus
  misc_feature (9)..(9): Xaa can be any naturally occurring amino acid
  misc_feature (13)..(13): Xaa can be any naturally occurring amino acid
  misc_feature (20)..(20): Xaa can be any naturally occurring amino acid
  misc_feature (51)..(51): Xaa can be any naturally occurring amino acid
  misc_feature (58)..(58): Xaa can be any naturally occurring amino acid
  misc_feature (63)..(63): Xaa can be any naturally occurring amino acid
  misc_feature (79)..(79): Xaa can be any naturally occurring amino acid
  misc_feature (102)..(102): Xaa can be any naturally occurring amino acid
ASWTGGKGXRKQXATKAARXSAPATGGVKKPHRFRPGTVALREIRRYQKSXELLIRKXPFQRXVREIAQDFKTDLRFQXSAVAALQEAAESYLVGLFEDTNXCAIHAKRVTIMPKDIQLARRIRGERA

SEQ ID NO: 30092 - protein, 320 aa, Roseovarius nubinhibens
MIGVMGAGAFGTALAVSLAAKGPVVLAARTEAQAEDIRQAGEVARLPGVTLPEAVQVGAGVAALAGCDIILLAVPTQKLRAMLMDAGGVFDAKTLVATCKGVEQGSQKSPSQVIAEVCPEAMVAVLTGPSFAADIARGLPTALTLACADRAAGKALQEALSVAHLRLYRSEDVTGAELGGALKNIIAIACGAAVGAGLGESARAALMTRGYAEMARMAEAMGARAETLAGLSGFGDLALTCTSEQSRNLRYGLALGRGETFDSGVTVEGAASAPAVVARAEALGIEMPITRVVVGLVSGQLRVAGAMDMLLSRPLKEEKC

SEQ ID NO: 30093 - protein, 145 aa, Oryza sativa
  misc_feature (109)..(109): Xaa can be any naturally occurring amino acid
MSAQIVPAPEHVCYVHCNFCNTIFAVSVPSNSMLNIVTVRCGHCTSLLSVNLRGLVQALPAEDHLQDNLKMHNMSFRENYSEYGSSSRYGRVPMMFSKNDTEHMLHVRXWAHFPNIHFGLGSHESSKKLDEAIGAPSPQKVQRLY

SEQ ID NO: 30094 - protein, 262 aa, Thermotoga maritima
MPVVTMKQLLEAGVHFGHRTRRWNPKMAPYIYTERKGIYIIDLQKTQQLLEEAYYFVREKASEGATILFVGTKKQAQGVIKAEAERCGAFYVNNRWLGGLLTNFKTIRSRIDKLIELEEMEQSGKLEELPKKEQSRIRRVLEKLRKNLGGLKEMRRLPDIIYIVDPRKEKIAVAEANKLGIPIVAIVDTNCDPDPIDYVIPGNDDAIRSIKLITSVIADAYLEGREGAPLTAEKEETESAEETSEEVTEDINLEELEEEEEV

SEQ ID NO: 30095 - protein, 830 aa, Unknown
  Frankia sp. CcI3
MKTTVSPDIAASPGVPAPTASGLAPGCAVPLGVTWDGSGVNIAVVAPGAEAVDFCLFDADGRETRHRLPERDGGVWHGYLAGVRPGQRYGLRAHGPYDPERGQRYNPAKLLVDPYTRSVAGTLRTDPAIYGFGGGDPYGFEPDPRDSAPFVPRCVVTGPGRAQRGSAGTRESGFGDPGIGDPGSGSGGLTGHGVHPADNRPTIPWSDTIIYEAHVRGLTKRHPDLPPRLRGTYAGLGHPSVLAHLRRLGVTAIELLPVHTSVSEPALLERGKINYWAYNTLAFFAPHAGYAATDDPIGEFQAMVAALHAVGIEVILDVVYNHSAEGSERGPTLSLRGLDNTTYYRVEPMDPRRYRDVTGCGNTLNTSSPHVVRLICDSLRYWVTEMGVDGFRFDLATALARNPDAFDPAASLLTAIHADPILATVKLIAEPWDVGWGGYQVGGFPAPWAEWNGRFRDTVRDVWNRYTSGVADLGYRVSGSSDLFEHGGRRPWASINFVTAHDGFPLADLVSYNEKHNEDNGEGNRDGEADNRSANHGMEGATDDPAILAIRRRVRRGLITTLLLSTGVPMLLAGDEFGRSQGGNNNAYCQDNAVSWLDWPTDLVGPEDVTGPEGVTGPEGVTGPEDVTGPEGVTGPEDVAEPDHAYPDPAGPDPALCRLVGGLAALRSAEPVLRRGRFFHGGQSAPGRLADITWFRADGAVMSVADWNAPQVETLVAHVAGSPVAGSPVDEDPAGGRGTHDLPAHGAGLVYVFHPDRGDTVVTLPGAPWAARHDLLLNTADDDLAGFPATVAVPGTSYVGGESLTVLGHSVLVLRAHPPGTAASPRCGDP

SEQ ID NO: 30096 - protein, 526 aa, Burkholderia vietnamiensis
MRRPWMPARSTFVSFMSAIPNSDPPGSPANPPTLHRALKARHLTMIAIGGSIGTGLFVASGASISQAGPGGAMVAYMLIGLMVYFLMTSLGEMAAFMPVSGSFATYGAKYVDEGFGFALGWNYWYNWAVTIAVELVAAQLVMHYWFPDVPGVWWSAAFLAVMFLLNALTVRGFGEAEYWFALIKVVTVLAFIGVGLLMIFGILKGAPANGWGNLTIGDAPFAGGLPALMGVAMIAGFSFQGTELIGVAAGESEHPRTTIPRAVRQVFWRILLFYVLAIFVIGVLIPYTDPNLLKSDVTDIGVSPFTLVFRHAGLAFAAGVMNAVILTAVLSAGNSGMYASTRMLYNLATEGRAPKLFAKLSPGGVPRNALYATTAVGALCFFTSLYGDKTVYLWLLNTSGMTGFIAWLGIAISHYRFRKGYVTQGYSIDQLPYQSKWFPFGPLFAFVLCMVIALGQDYQAFLANRIDWAGVAATYVGIPLFVVVWLGYRLMNRSRFVRYEDMEIAPWIAANRGGAAPRVENRETAG

SEQ ID NO: 30097 - protein, 518 aa, Unknown
  Rhodococcus sp. RHA1
MSTRVNEIQAPVWNEPIIMEMGYPGRRGAVFSHAEDGIEARVGAAVDLIPTAVRRGDRPALPEMSEPEVLYHYLRLSQQTLGMMGVSLFGTCTMKYNPQVNEALAWRPEVTEVHPLQHEDTLQGTLEIVHGMDLILRELSGMDQFVFQAGGGAEAAFVNASVTRAYHASRGELEQRNEVITTIQTHPCNAATAAAAGFKVITLMLDENGYPSLDALKAAVSNRTAALMVGNPDDMGVYNPEMKEWVEIVHEAGGLCFYDSANFNGTMSKIRPREIGFDACMFMLHKTFGAPKSGVGGPATGAYGCSAELAPFLPAPLVTFDGERYHLDHDRPDSVGKIREFWGNVPVILKAYAWVRAMGAEGIAQASDISVLGNNYMEKGLLAIRGVTRSHPESTSPRLEMTRYSMQILKEDTGVDVHDVQNRMTDFGIDAMWTSHEPWLIPEPFTPEAGEMYGKESLDQWIAVLAQISDEAYSNPDIVKSAPHNQAIHRLKPGVTDDPSTRAMTWRAFQRSRAQSRS

SEQ ID NO: 30098 - protein, 469 aa, Unknown
  Rhodococcus sp. RHA1
MSNSTAHPYMANSVPALQQEMLDAIGVPTIAELFQQIPTDHRTTRKFDLPPTLGEAELRRHLVNTLAKNRTCEQNLNFLGAGLWQHHVPAACDEVVRRNEWLTSVFGEPSSDHGRNQAWFEFCSQLGELLKLDLVGLPVRSWGSAAGHALRMAARITQRAEVAVVRAIDPERLSVIRNYCEPTEMESHIAVRLIDYDPASGLIDLDDLRAAVGEHTAAVYFETPSYLGVIEHQGAEIAAIARAVGAETIVGVDPISLGVLSSPVDFGADIVVGTTQPLGIHMHTGGGVGGFIASRDEDRYAHQYPTLFISIAETIKPGEYGFGLGLFEQSSYGLRDKGNDWTGHSVYMWAIAATTYMALMGPQGFEDVGGLILQRAHYAAQLLSEIDGVRVAFPSGFFKEFVINFDNTGKTVEEINDALLNIGIFGGKDLTRDFPELGASALYCVTEIHTKADIDRLVGALREVTANEH

SEQ ID NO: 30099 - protein, 508 aa, Unknown
  Populus tremula x Populus tremuloides
MEIEGQATVKESQPPKFALPVDSEHKATEFRLFSVAAPHMRAFHLSWVSFFACFVSSFAAPPLLPIIRDNLNLTASDIGNAGIASVSGAVFARVAMGTACDLFGPRLASASLILLTAPAVYFTSMASSSTSFLLVRFFTGFSLATFVSTQFWMSSMFSAPVVGTANGVAGGWGNLGGGATQLIMPLVFGLIRDIGAIKFTAWRIAFFIPALFQTLSAFAVLIFGKDLPDGNFRRLQKAGDKTKDKFSNVFYHGIKNYRGWILALSYGYCFGVELTIDNIVAEYFYDRFDLKLHTAGMIAASFGLANIVSRPGGGMISDAVGKRFGMRGKLWALWVVQTLGGVFCIILGRVGSLGASIVVMIVFFLFCQAACGLTFGVVPFVSRRSLGLISGMTGGGGNVGAVLTQLIFFRGSKYSKERGIMLMGVMIICCTLPICLIHFPQWGGMFCGPSSTKIATEEDYYLSEWNSEEKEKGLHLSSLKFADNSRSERGRKEDSETRPVDETLSTKV

SEQ ID NO: 30100 - protein, 436 aa, Bacillus anthracis
  misc_feature (19)..(19): Xaa can be any naturally occurring amino acid
MIGRGWDDMFCYQCEQTPXGGCKVMGVCGKNETIASLQDTIVFGLKGIAAYRTHAAQLGYTDAFVDATTQEALYMTLTNSNFNEQEHIDMAMKVGKSALRVMELLDKAHTNHFGVPEPVQITQNRVEGKAIVVTGHNLFALEELLKQTEGKEINIYTHSEMLPAHGYPQLKKYKHLKGNIGKAWYDQRRLFEKFTGAILATTNCVMPIKGSYSDRFFSYDIAGLEGVQKIENDNFAPLIQKALELPEVHMESDEQLVTGFHHNTVLSLAPEIIEAVKEGKIKRFFVIAGCDAPGKGGEYYRELATSLPPETVILTTSCGKFRFNDVDYGVVPGTEIPRYIDLGQCNNSISTVKIAAALADAFQCEVNELPVSIVLSWFEQKAVAILLGLFSLGIQDIRIGSKAPEFISAGVLDVLQETFGLKLITTAAEDMEMMLS

SEQ ID NO: 30101 - protein, 411 aa, Vitis vinifera
MNALAATNRNFRHASRILGLDSKLEKSLLIPFREIKVECTIPKDDGSLATYVGFRVQHDNARGPMKGGIRYHPEVDPDEVNALAQLMTWKTAVVDIPYGGAKGGIGCTPKDLSMSELERLTRVFTQKIHDLIGTHTDVPAPDMGTNAQTMAWILDEYSKFHGHSPAVVTGKPIALGGSLGREAATGRGVVFATEALLAQHGKSIKGLTFVIQGFGNVGSWVARLIGERGGKIIAVSDVTGAVKNQNGLDIVDLLRHKEETGCLTNFSGGDHMDPNELLTHECDVLIPCALGGVLNKENAADVKAKFIIEAANHPTDPEADEILSKKGVVILPDIYANAGGVTVSYFEWVQNIQGFMWEEEKVNNELQKYMTKAFHNIKAMCQSHNCSLRMGAFTLAVNRVACATTLRGWEA

SEQ ID NO: 30102 - protein, 116 aa, Glycine max
  misc_feature (34)..(34): Xaa can be any naturally occurring amino acid
  misc_feature (82)..(82): Xaa can be any naturally occurring amino acid
  misc_feature (111)..(111): Xaa can be any naturally occurring amino acid
KIYCPNVSTVNHAGAGMVAPFTGLKSMADFPTRXTNNDITSIASNGGRVQCMHVWPPDGKNKVDTLPYLPDLDDAQLANEGXYLHTKGWIPSLEYELEHGNVYPEHNMSPXYYDGR

SEQ ID NO: 30103 - protein, 281 aa, Solanum lycopersicum
RDFLKAEKAAKSLGIPKVNYTVMHLDLASLESVRQFVDNFRRSGRPLDALVCNAAVYLPTAKEPTFTADGFELSVGTNHLGHFLLSRLLLDDLKQSDYPQKRLIIVGSITGNTNTLAGNVPPKANLGDLRGLSGGLNSLNCSPMIDGGEFDGAKAYKDSKVCNMLTMQEYHRRFHEETGIAFASLYPGCIAETGLFRNHIPLFRTLFPPFQKYITKGYVSEEEAGKRLAQVVRDPSLSKSGVYWSWNSTSSSFENQLSKEASDAEKARKLWEVSEKLVGLA

SEQ ID NO: 30104 - protein, 852 aa, Streptococcus thermophilus
MNTTEKIQTYLNDPKIVSVNTVDAHSDHKYFESLAEFSEGEMKLRQSLNGKWKIHYAQNTNQVLKDFYKTEFDETDLNFINVPGHLELQGFGSPQYVNTQYPWDGKEFLRPPQVPQESNAVASYVKHFTLNDALKDKKVFISFQGVATSIFVWVNGNFVGYSEDSFTPSEFEISDYLVEGDNKLAVAVYRYSTASWLEDQDFWRLYGIFRDVYLYAIPKVHVQDLFVKGDYDYQTKAGQLDIDLKTVGDYEDKKIKYVLSDYEGIVTEGDASVNGDGELSVSLENLKIKPWSAESPKLYNLILHVLDDDQVVEVVPVKVGFRRFEIKDKLMLLNGKRIVFKGVNRHEFNARTGRCITEEDMLWDIKVMKQHNINAVRTSHYPNQTRWYELCDEYGLYVIDEANLETHGTWQKLGLCELSWNIPVSEPEWLPACLDRANNMFQRDKNHASVIIWSCGNESYAGKDIADMADYFRSVDNTRPVHYEGVAWCREFDYITDIESRMYAKPADIEEYLTTGKLVDLSRVSDKHFASGNLTNNPQKPYISCEYMHTMGNSGGGLELYTDLEKYPEYQGGFIWDFIDQAIYKTLPNGSEFLSYGGDWHDRPSDYEFCGNGIVFADRTLTPKLQTVKHLYSNIKIAVDEKSVTIKNDNVFEDLSAYTFLARVYEDGRKVSESEYHFDVKPGEEATFPVNFVVESSNSEQIYEVACVLREATEWAPKGHEIVRGQYVVEKISTETPVKAPLNVVEGDFNIGIQGQNFSILLSRAQNTLVSAKYNGVEFIEKGPKLNFTRAYTDNDRGAGYPFEMAGWKVAGNYSKVTDTQIQIEDDSVKVTYVHELPGLSDVEVKVTYQVD

SEQ ID NO: 30105 - protein, 420 aa, Rickettsia rickettsii
MNIFNNNLHETDKEINEIIKHEKLRQSSVIELIASENFVSPAVLEAQGALLTNKYAEGYPSKRFYNGCEEVDKAENLAIERVKKLFNCKYANVQPHSGSQANQAVYLALLQPGDTVLGMSLDSGGHLTHGAAPNMSGKWFNAVSYSVNKETYLIDYDEIERLADLHKPKLLIAGFSAYPRNIDFAKFREIVDKVGAYFMADIAHIAGLVATGEHQSPIPYAHAVTSTTHKTLRGPRGGLILSNDEEIGHKINSALFPGLQGGPLMHIIAAKAVAFLENLQPEYKSYIQQVISNAKALASSLQERGYDILTGGTDNHIVLVDLRKDGITGKLAANSLDRAGITCNKNAIPFDETSPFITSGIRLGTPACTTRGFKEKDFVLVGHMVADILDGLKNNEDNSALEQQVLNEVTKLIELFPFYG

SEQ ID NO: 30106 - protein, 852 aa, Streptococcus thermophilus
MNTTEKIQTYLNDPKIVSVNTVDAHSDHKYFESLAEFSEGEMKLRQSLNGKWKIHYAQNTNQVLKDFYKTEFDETDLNFINVPGHLELQGFGSPQYVNTQYPWDGKEFLRPPQVPQESNAVASYVKHFTLNDALKDKKVFISFQGVATSIFVWVNGNFVGYSEDSFTPSEFEISDYLVEGDNKLAVAVYRYSTASWLEDQDFWRLYGIFRDVYLYAIPKVHVQDLFVKGDYDYQTKAGQLDIDLKTVGDYEDKKIKYVLSDYEGIVTEGDASVNGDGELSVSLENLKIKPWSAESPKLYNLILHVLDDDQVVEVVPVKVGFRRFEIKDKLMLLNGKRIVFKGVNRHEFNARTGRCITEEDMLWDIKVMKQHNINAVRTSHYPNQTRWYELCDEYGLYVIDEANLETHGTWQKLGLCEPSWNIPASEPEWLPACLDRANNMFQRDKNHASVIIWSCGNESYAGKDIADMADYFRSVDNTRPVHYEGVAWCREFDYITDIESRMYAKPADIEEYLTTGKLVDLSRVSDKHFASGNLTNNPQKPYISCEYMHTMGNSGGGLELYTDLEKYPEYQGGFIWDFIDQAIYKTLPNGSEFLSYGGDWHDRPSDYEFCGNGIVFADRTLTPKLQTVKHLYSNIKIAVDEKSVTIKNDNVFEDLSAYTFLARVYEDGRKVSESEYHFDVKPGEEATFPVNFVVESSNSEQIYEVACVLREATEWAPKGHEIVRGQYVVEKISTETPVKAPLNVVEGDFNIGIQGQNFSILLSRAQNTLVSAKYNGVEFIEKGPKLNFTRAYTDNDRGAGYPFEMAGWKVAGNYSKVTDTQIQIEDDSVKVTYVHELPGLSDVEVKVTYQVD

SEQ ID NO: 30107 - protein, 710 aa, Kineococcus radiotolerans
MVRVAGRDLDHQVRVAGDAEALHDLGDAGHVLDHPVELALLHARRDQGAHGQPDPRRVQPRRVQPQRAVAGELLQPAVHRAPGQAQVHGQLRDGGARVAVEGDEDAPVRAVQGGHVDHPRRGRGSGTGRNDQRRRALLRDPPGRACHHGMTPAPAPDTSTTTVGGYLGRRLEQLGVGHVFGLPGDFNLALLDEVLAATGLRWVGSSNELNAGYAADGYARLRRGPAAVVTTFGVGELSAVNALAGSYAEDVPVVHVVGLPPTTAMSRGALLHHSLADGDFGHFVRIAAEVTASAVVVRAQGATTAIDQALLTAVGTSKPVYLGVPADVAVHPVPAAPLSRPLRVLRSDAGAAEEFRTALAQFLGDAPEVTVLAGPRLHRRNLEDLVRAIAAQNGVRVATQSASKAMLDESHPANLGVYAGEFTRSARTRRAVDGARPLVLAGVLMSDFLTGSFSHAFDPEASVDLQLDHARIAGTAFYGLYLEESLRILEEVLDARSPRPGPLPRQEVPALAPHVPAEPDGPLTHADLWPLLQRWLNPGTLLVAEAGTSFYGALELTTPDGCDLLGQPVWSSIGYTLPATLGAMLARPGRETVLVIGDGSAQLTIQELGRILAEGLTPTILLVNNSGYTVERAIRSPEAVYQDVVAWDWTKLPAALGSPGTPTYRAATPADLVEVLGKVRADPDHAAFVELLLPRDDAPDSLVQLARSVR

SEQ ID NO: 30108 - protein, 191 aa, Glycine max
NLFLLTMHSHIERILWSEDQISRRVFELAAEISDDFGGHSPAPVVVGVATGAFLFLADLVRKIDLSIAVDFVRVESYGSGTVSNGAPTISFDLKVDVNSRHVIVVEDIVDTGHTLSKVIEHLKSKGASSVSVCTFLDKPARRKVHFQLVGEGKYYRGFECPNYFVVGYGLDFAELYRNLPYIGVLKPELYK

SEQ ID NO: 30109 - protein, 528 aa, Clostridium perfringens
MNNIKFDDLGLKESLLKAIKDMGFEEPSQIQAESIPVALEGHDIIGQAQTGTGKTAAFGCAIINNADFSGKKKSPKALILAPTRELAIQVNEELVRLGKHEKLSVLPIYGGQPIDRQIRALKNGVDIVVGTPGRVLDLIRRKSLPLNDIGFLVLDEADEMLNMGFIDDLEEIVKSLKTDRQTLLFSATMPPQIKKLARNYMKEDTKHIAIKKSSLTVSKIEQFYFEIKHRDRFETLCRVLDFDEPNAAIIFCKTKKGVDEVVEKMQARGYMVEGMHGDMSQNHRLQTLRKFKEGSLDFLVATDVAARGIDVESVTHVINYDLPQDNESYVHRIGRTGRANREGVAYSLVTPKEYMMLKQIQKHTKSKIIRKAVPTVDEIFQNKHNNIINNVKSTIEEASEDFQKFIPIATQLDEDYSLVDVAAALLKIVFDKESSFDYTSNSIEAPVMDETRLFMSVGRRDGITPKSLVNFLKETARISPKQVGDIDIKENFCFANVDADAVNNIMKKSMGKKLNKRTVNIEVAKKRK

SEQ ID NO: 30110 - protein, 620 aa, Arabidopsis thaliana
MVLEDRKDGSSLPGRSGSFSKSSPSELDVVDPYKRISSPGSILDAEKVEKKPGGWRAVSFILGNETLERLGSIGLLANFMVYLTKVFHLEQVDAANVINIWSGFTNLTPLVGAYISDTYVGRFKTIAFASFATLLGLITITLTASFPQLHPASCNSQDPLSCGGPNKLQIGVLLLGLCFLSVGSGGIRPCSIPFGVDQFDQRTEEGVKGVASFFNWYYMTFTVVLIITQTVVVYIQDQVSWIIGFSIPTGLMALAVVMFFAGMKRYVYVKPEGSIFSGIAQVIVAARKKRKLKLPAEDDGTVTYYDPAIKSSVLSKLHRSNQFRCLDKAAVVIEGDLTPEGPPADKWRLCSVQEVEEVKCLIRIVPIWSAGIISLAAMTTQGTFTVSQALKMDRNLGPKFEIPAGSLSVISLLTIGIFLPFYDRVFVPFMRRITGHKSGITLLQRIGTGIVFAIFSMIVAGIVERMRRIRSINAGDPTGMTPMSVFWLSPQLILMGLCEAFNIIGQIEFFNSQFPEHMRSIANSLFSLSFAGSSYLSSFLVTVVHKFSGGHDRPDWLNKNLNAGKLDYFYYLIAVLGVVNLVYFWYCARGYRYKVGLPIEDFEEDKSSDDVEMTSKKSMK

SEQ ID NO: 30111 - protein, 561 aa, Magnaporthe grisea
MTSLRDIIIAAFKSLTRGKSFIRALLAFWISPNVIKECQESNDGSSSPRLLEDFLLEVEHLLSQPIEPAALLGFSGNLKKQFRQRLWSNRACMLPSYNYQLPNGSEQGRYLSVDVGGSTLRVALVELKGLEEGGYDGCSRIVRIDNFRIDVGVKALVGRAFFDWMAARILETLKSASEGGQNNKEEFNGSPQAPIPMGLAWSFPIEQTSLKGGLLQNMGKGFLAADGLLGQDLGEIVKQACSGHNLHVEVAAIINDSSAALLSESYRRPSTRFGLILGTGFNIAAYMPVTTIERPKFGVRPASWFEKASHVIVNTEMGMFGQGFLPMTRWDEQLKAAHPKPEFQPLEHFVAGLYIGELARLIMIDAIETTGLFGGVVPPSLVGPYTLETETLSILESDDSVNLENALAAFTSRHPSSQKPIVSDILALRTISKLVTRRSAALVAAALYGLWELKRETENEYLEPQETVKSTDMPFAQETRAELDLGRVVVGFNGSVIEQYPGYRTNCQIYIDALFKRSQEQLSQGGGLSREEALIELVPAKESSLLGAAVALACLERGKAN

SEQ ID NO: 30112 - protein, 434 aa, Arabidopsis thaliana
MRNLSFIVLFLLTLFFIHHLVDASLLVKSLPGFEGPLPFELETGYVSIGESGDVELFYYFVKSERNPENDPLMIWLTGGPGCSSICGLLFANGPLAFKGDEYNGTVPPLELTSFSWTKVANILYLEAPAGSGYSYAKTRRAFESSDTKQMHQIDQFLRSWFVKHPEFISNPFYVGGDSYSGKIVPGAVQQISLGNEKGLTPLINIQGYVLGNPVTDKNIETNYRVPFAHGMGLISDELFESLERSCGGKFFNVDPSNARCSNNLQAYDHCMSEIYSEHILLRNCKVDYVLTYRYFLSAFWANDENVRRALGVKKEVGKWNRCNSQNIPYTFEIFNAVPYHVNNSLKGFRSLIYSGDHDSMVPFSSTQAWIRALNYSIVDDWRPWMMSSNQVAGYTRTYANKMTFATIKGGGHTAEYTPDQCSLMFRRWIDGEPL

SEQ ID NO: 30113 - protein, 907 aa, Botryotinia fuckeliana
MASAQFMNEHSSEADAEMSKMIPQLPQTPPDSNENSSDELGSLSSYSSSTSLSLQRYTLPPPTNPPTEILKEDLKTPDNQVPRDPRLIRLTGIHPFNVEPPLSALYDEGFLTSPELFYVRNHGAVPHVEDSSIPDWEFSVEGLVKKPFTLTLKDLLREYEQITVPITLVCAGNRRKEQNQVRKSKGFSWGAAGVSTALWTGVPMYELIRKAMPMRGAKYVCMEGADKLPNGYYGTSLKLNWVMDPNRGIMVAHKMNGEMLRPDHGKPLRAVVPGQIGGRSVKWLKKIIVTAAPSDNWYHIYDNRVLPTMISPEQSANEPKWWTDERYAIYDLSTNSATAYPEHEERLSLVSGQQTYRAKGYAYGGGGRRVTRVEVTLDKGKSWALLDIRYHEDDYRDRAYENETLFGGKLDMEWRETCFTWCFWEVDLDVQDLAMSGDIMVRAMDESMNVQPRDMYWSVLGMMNNPWYRVTITKEGDYLRFEHPTQPALMPGGWMERVKSAGGNLANGFWGEKMGTEDESVALVEVKQEIKMTKDDVKREISIEELRQHDNEKEPWFVLNGEVYDGAPFLEGHPGGATSITGAAEDSTDEFMAIHSETAKAMMPAYHIGTLSPSAFTSLLNPEPLSSSSQSLRPIFLQPKSWQKAVLTAKKVISSDTRIFSFTLDHAEQVIGLPVGQHLMMRLRDPVTREAIIRSYTPLSLGTDKGVLDILIKIYLKNEKGPGGKMTMALESIPVGHSIDFKGPIGKFEYVAKGECVIGGKKRRVKRFVMICGGSGVTPIFSVLRAVLNEEEVGGAPKCIVLDGNRREEDILCREELDDLVKGNEQRCRLVHALSQPTEEWKGLRGRLGKEVLEKEVGRFEMDMDGEGNGYRDGEQLVLICGPEALEKNVHGILSDLGWKDQDILFF

SEQ ID NO: 30114 - protein, 115 aa, Musa acuminata
PGREDKTLPREEGRLPDATKGSDHLRDVFGHMGLSDQDIVALSGGHTVGRCHKERSGFEGAWTSNPLIFDNSYFKELLSSEKDDLIQLPSDKALLTDPVFRPLVEKYAADVNACS

SEQ ID NO: 30115 - protein, 733 aa, Oryza sativa
VEAVVMPERYALGGACRVLAGMPAPLGATALDGGVNFAVYSAGASAASLCLFTPDDLEADEVTEEVPLDPLFNRTGNVWHVFIEGELHNMLYGYRFDGMFAPHCGQYFDVSNVVVDPYAKAVISRGEYGVPGPGGDCWPQMAGMIPLPYSTFDWQGDLPLRYPQKDLVIYEMHLRGFTKHSSSNVEHPGTYIGAISKLDYLKELGVNCVELMPCHEFNELEYFSCSSKMNFWGYSTINFFSPMIRYSSGGIRNCGRDAINEFKTFVREAHKRGIEVIMDVVFNHTAEGNEKGPILSFRGIDNSTYYMLAPKGEFYNYSGCGNTFNCNHPVVREFIVDCLRYWVTEMHVDGFRFDLASIMTRGCSLWDPVNVYGSPVEGDMTTTGTPLATPPLIDMISNDPILGDVKLIAEAWDAGGLYQVGQFPHWKIWSEWNGKYRDIVRQFIKGTDGFAGGFAECLCGSPHLYQAGGRKPWHSINFVCAHDGFTLADLVTYNKKYNSSNGEDNRDGENHNLSWNCGEEGEFAGLSVKRLRKRQMRNFFVSLMVSQGVPMFYMGDEYGHTKGGNNNTYCHDHYVNYFRWDKKEESSDLQRFCSLMTKFRKQCESLGLADFPTAQRLHWHGHQPGKPDWSETSRFVAFSTKDETKGEIYVAFNASHLPAVVGLPERPGYRWEPLVDTGKPAPYDFLTDDLPDRVTPSTCSLISSTPISTPCSATPPSSLNCSLMIERTKYSIV

SEQ ID NO: 30116 - protein, 714 aa, Treponema denticola
MMNMNDLSFFQGKASPLGAKLSCDGVNFSVFSRNAKEIVLHLFENVEDSEPIISYKLDPQINKTGDVWHVFVSGLKSWAFYLYTADGEFSPSAGFLFDENNYLLDPYARLISSHSVFNSEQTFNQKDSKASGGKNQHKRTAKGFPKCVVIDDREFDWQGDKPLNIPLQKCVIYEAHVKGFSFLNDKISPTKRGKYSGLVELIPYLKDLGITSLELLPVFDFDENENMNINPKTGVRLKNYWGYSTIAFFAPKALYAEDPGNAVNEFKFMVREFHKAGIEIILDVVFNHTAEGNENGPVFSFKGFDNSIYYHLEDNKFYYKNFSGCGNSLKTSEIPVIKFILDCLRYWVTEMHVDGFRFDLAPVLARDKTGSIDLNSFMIQAIADDSVLRSTKIIAEAWDAAGAYMVGKFPGRWAEWNDLFRNSVREFWLQPNPDIRHLATRVTGSADLYSQKGRRPYQSINFVCCHDGFTLCDLLSYSEKHNEENGENNRDGSNENLSYNHGIEGSASVEIERMRMRSAKNILTTLILSAGTPMINMGDEVFRTQNGNNNAYCQDNEMSWFDWELLNENKDLLEFTKKLINLRKTHFSFLRKHFFTGASKINGTPSDITWFDYNAQKPNWNVPSNFLAFLIDGNKINLESDEDDNDFYVMTNSYNNDITVRLPPPSSGGKIWHRLIDTSYTDGKDFLDEEHTEQIMNQQIYVVLSRTTVVLIAK

SEQ ID NO: 30117 - protein, 188 aa, Medicago sativa
AWHSAGTFDSKTKTGGPFGTIKHQAELAHGANNGLDIAVRLLEPLKEQFPIISYADFYQLAGVVAVEITGGPEVPFHPGREDKPEPPPEGRLPDATKGSDHLRDVFGKAMGLSDQDIVALSGGHTIGAAHKERSGFEGPWTSNPLIFDNSYFKELLGGEKEGLLQLPSDKALLSDPVFRPLVEKYAAG

SEQ ID NO: 30118 - protein, 188 aa, Brassica napus
MIISKKNRNEICKYLFQEGVLYAKKDYNLAKHPQIDVPNLQVIKLMQSFKSKEYVRETFSWQHYYWYLTNDGIEFLRNFLNLPSEIVPATLKKSARPPGRPLGSGPPGDRPRGPPRFEGDRPRYGDRDGYRGGPRGAPGDFGGEKGGAPAEFQPSFRSSGGGGFGRGGGGGFGRGGGGGGGFGASPME

SEQ ID NO: 30119 - protein, 216 aa, Triticum aestivum
RPGTGLVLVDLVNGFCTVGAGNLAPVTPNKQIEKMVEESTRLAKVFCQRNWPVFAFLDTHHPDKPEPPFPPHCIIGSGEENFVPALEWLENDPNVTMRRKDCIDGYLASFEKDGSNVFSEWVAKFQIKTVLVVGICTDFCVLDFVSSTLAARNIGRVPPLEDVVIYSEGCATFDLPVEVARSIKGALAHPQDLMHHMGLYMAKSRGAKIVDGILEE

SEQ ID NO: 30120 - protein, 219 aa, Prunus armeniaca
MEKTECSEAENFGSVTTSLEPQATAKRKKAKSKNQRRFSDEQIRLLESIFEADSKLEPRRKVQVARELGLQPRQVAIWFQNRRARWKSKQIEQDFRTLRADYDNLASRFESLKEEKQSLLMQMQKLNELVGKPSQGLEGNIMVDGSRLQEELEPRGVIQSHKNNTSNDVGCHGDEIHELLSMAHVDASSLSPQDWHRFEPSILFDPSRFTSSHWLNFWT

SEQ ID NO: 30121 - protein, 332 aa, Francisella tularensis
MQKNILVLGAGAWGTALALQLAYRGHNVRINSWKAEHNEQMLKDNNNHKYLPSIEKFPSRLKAIQDWQANIIEFDSILVATPSSGFKNTILELKECILPQQNIISATKGFCHDSYALLSEIAEDILPTTKFALLTGPSFAKELANQLPTAVVVASKDINYARYVQELFSNENFRCYTTTDIIGAQVGGAVKNVLAITAGIAAGMEFGVNAHAALITRGLAEIKKLGLKLGANSETFIGLSCLGDLLLTCSDNQSRNRRFGLYLGQGMTIQQALKEVNNVVEGYFTAKAVYNFAKKHNVEMPLVFATYRILYEAADPRDIVKELMTRQLKNEN

SEQ ID NO: 30122 - protein, 718 aa, Zea mays
PISLVRDRRLKEMLAAEGIVVQSFNSDLLYEPWEVVDDEGQPFTMFDPFWNRCLSMPYDPPAPLMPPKRINSGDLSMCPSEDLIFEDESERGSNALLARAWTPGWQNADKALTAFLNGPLADYSVNRKKADSASTSLLSPHLHFGELSVRKVFHLVRMKQLVWSNEGNHAAEESCTLFLRSIGLREYSRYLSFNHPSSHERPLLAHLRFFPWVVDESYFKIWRQGRTGYPLVDAGMRELWATGWLHDRIRVVVASFFVKVLQLPWRWGMKYFWDTLLDADLESDALGWQYITGSLPDGRELDRIDNPQFEGYKFDPHGEYVRRWIPELARLPTEWIHHPWDAPVSVLQAAGIELGSNYPLPIVELDAAKGRLQAALSEMWQLEAASRATMNNGTEEGLGDSSEVLFPQELQMEVDRQPAPAEAAANVHVHVPMPARRRGDQMVPTMTTSSLNRAGTEVSADLVVANSEEEDTRAQVPFHAHLHLHPRAEAPPAARRTNNGARQHDVFQQRRNHRRDALLAPSASEASSSWTGREGAVVPVWSPPAASGHSDAFAADEADVSSRSYLGRHPQSHRLMNWSQLSQSSTAAEDSVRPNLIELKILVAIIDQTTKVFRIFLAFFGGGVAALVHWIEKRASDVMDADLGVEGHEHAPRQALRCVHVALLCVQSDRSRRPTMGQVIAMLSSGDDGTDDLPEPSLPGYVLRPMAASGVQLCFGCR

SEQ ID NO: 30123 - protein, 243 aa, Oryza sativa
  misc_feature (208)..(208): Xaa can be any naturally occurring amino acid
  misc_feature (231)..(231): Xaa can be any naturally occurring amino acid
  misc_feature (238)..(238): Xaa can be any naturally occurring amino acid
MTDPSRYKLNHSMIRIKDPKRSLEFYQFLGMTLINKLPNPDAKFDLYFLAYDSPKAVSHGNHWTDREGIVELTHNYGTEDDPDYQITNGNAEPYKGFGHLCISVDNLQAACQRLEDAGYKFQKKLTDGRMRHIAFVLDPDGYWVEVIGQKSLEQTENVKETDISTYRMNHTMIRVKDKDISLRFYQDVMGMKLKRTSESPNAGFNLYXLGYGPDAPQSTANGVNPGADHEXLLELTWXYGTEK

SEQ ID NO: 30124 - protein, 297 aa, Bacillus anthracis
MQVGLIGLGKMGLNLGKNLIDHKHEVAAFDLNASAVEEMKEYGATGASSLNELVQSLQSPRVLWVMVPHAVVDSVIDEVTPLLSKGDILIEAGNSHYKESIRRYEQLKKDGIHFMDAGTSGGMEGARNGACYMIGGDQEAWDIVEPIFRDTAVENGYLYAGKAGSGHFLKMVHNGIEYGMMAAIGEGFEILEKSEFDYDYEKVSRVWNNGSVIRSWLMELTENAFSKDAKLDEIKGVMHSSGEGKWTVETALDLQTATPVIAMSLLMRYRSLDNDTFTGKVVAALRNEFGGHAVEKK

SEQ ID NO: 30125 - protein, 541 aa, Treponema denticola
MEWWNKRVFYQIYPRSFCDANNDGMGDIQGIISKLPYLKELGIGAIWLSPVTASSDYDNGYDVSDYCDINPKFGTMDDFKSLLKEADKLDIKIVMDLVINHTSDQHRWFIESKNPESPYHNYYVWKEPRLVKGKKLPPNNWDSLFLGSAWKYCEENGLYYLHLFTENQPDLNYNNPAVTEEVKKILKFWLDMGVAGFRCDVINCIYKTSYEDAKKRRIKTGKEFYLSQKGCHDILKELNRDVLKPYNAFTVGETMDVSLEEAKDFIQDELTLVFPFEHHTGVDCWFQIPVLKRKYKPFRMIKILKKWQTKMPWTPLFFENHDQARSVSRFGDEGKYYKESVKMLATVLLTQKGTPFIYQGQEIGLTNTDFKSMDEIDDIATKNIYDTLRRLKFGKKRAFKMTMNYARDHARTPIPWDDSENGGFCTVKPWLRLNEKYKEINVKKNLSESDSCFNYYKKLIALRNEEEVLQLGDIEFADLGKDIFAYYRKKGDKTFFIVSNMSGKAQKIREEVRGLPILFNYRNFNPQQKILRPFESVITRI

SEQ ID NO: 30126 - protein, 220 aa, Arabidopsis thaliana
  misc_feature (21)..(21): Xaa can be any naturally occurring amino acid
  misc_feature (25)..(25): Xaa can be any naturally occurring amino acid
  misc_feature (149)..(149): Xaa can be any naturally occurring amino acid
MASSMLSSATMVASPAQATMXAPFXTGLKSSAAFPATRKANNDITSITSNGGRVNCMQVWPPIGKKKFETLSYLPDLTDSELAKEVDYLIRNKWIPCVEFELEHGFVYREHGNSPGYYDGRYWTMWKLPLFGCTDSAQVLKEVEECKKXEYPNAFIRIIGFDNTRQVQCISFICLQAHQASPVKFPLLLLCKPSKLYPPSLILSLVFLLFSSFLGFNFRT

SEQ ID NO: 30127 - protein, 1230 aa, Cryptococcus neoformans
MNGFMPALRLHHTHSSSVSPTASNDAASSSPTSSQPHQLAAYSPLYATSPNRGSKITKGSSLSSSTAHHGLKYVRPSTSPLLKPPKGKSFSEYLGDWGSQELFTFLDIHKCGQYLAIFQENDINGKILLDLDVTALKSMGIDKISERVRLIGGIKDLRKRIADETIRAPFIQRCYPPERTLLPSLPSHSNVFLDKWDYSSSASRLGKGQIAFRPPPLDLQGHMPRKLLPHASQGIATIDTHDIRTTKPKIEAYIQQNPLGQPQSVPTKRSDSLTLCAPPSRNVRRRSPSSRHFEGRESQTDGFTILNMASDRQVPSSTMNSVTLGEDCHLQREEGLPLFLKVPQFRNTFASSHKTLIAGRGPLTRGDTISHQPSGPAIAGQDSPVNYRISKTVTTTKEASQGDLEHPFAVKSIGSQLGLLVGVSGMAHDPVTDGSKSKGKTSVPLTGTSSSDISAVNANSAALSLADLRRQLVKFINTEDDTIRTVNVMHVTSGEEILERALKKFGKWGTGMHSSPDVYGDEDGDETLEIDGWEVYTERTPDESSKPLSESSLLKTCTFHREGTAIQDKGLFLRKKQRLQKRKNIQHFFGETLPPPMSPTSPTLITGPHLGIVQGKSQLASEPAFSSSNRLSTLTNKGPNRASMISVMSGLGVPVINTLPSPQGNGLCPTGSVHSHKKKSMYNFFGHRPPSELISNHLADYFPSAKKSDVEKARHSLLRLSGDTVAYKKNGIDEGDNAPDHWSKPGNNQPPSLPPFEPSQDTLSDSLQAYASSTPVYLSRPKHNVALRRRRDSDSSSRSHTSVLMQTRRNRDRSDTASLLTVDEITAEVENRRASTIPKGDYIEETEDSSFIEGDTLPEYEESKGLLRTVCSDSNSIVDSGKSFQRDSDVDQQQELEDEEEDELDDEEEEEEEEKEDEDEQGKAFTSTGSKRIIKWIKGALIGAGSFGSVYLGMDAQSGLLMAVKQVELSAGSVKSEDRKKSMLSALEHEIELLKELQHENIVQYLDSSVDTNHLNIFLEYVPGGSVAALLNNYGAFEEGLVRNFVRQILTGLNYLHMRGIVHRDIKGANILVDNKGGIKISDFGISKKVENSLISGLRTNRPSLQGSVFWMAPEVVKQTSYSPKADIWSVGCLVVEMLTGTHPWADLTQMQAIFRIGSLARPAPPSDISVQADEFLRKTFEIEHAKRPTAAQLLKDPFIDSPRVRTTASNFISEAIVSEKMEVQVVEEM

SEQ ID NO: 30128 - protein, 637 aa, Senecio squalidus
MKTGQNFTLTSWLSNDIPDSGSFTLSWEPVDEASQRLIIRRSHQPYWTSGNLNDQTFQYLYALNSPGSQSHYNLSSVYSNEARYFSYERTNADLPMWILTPKGQLRDSDNSTVWTPEFCYGYESSNGCVESSLPQCRREGDNFSEKNGDFAPDIARSATDDNSSLSISDCFVKCWNDCSCVGFNSSTTDGTGCVIWTGSNNFLVNPRDNSTLKYVISQSPINPSAGNKTEESKTKESKTWIWILLGVVIPLALLCFGLLLYTKIKHRRKEYERRKRDEYFLELTASESFKDVHQLESNGGKGNDLLLFSFSSIMAATNDFSVENKLGQGGFGPVYKGKLSDGREIAIKRLSRTSGQGLVEFKNELILIAKLQHTNLVRVLGCCIHGEEKMLIYEYMPNKSLDFFLFDENRKAELDWPKRFNIIEGIAQGLLYLHKYSRMRVIHRDLKANNILLDENLNPKISDFGMARIFKENETEAMTNRVVGTYGYMSPEYAMEGTFSIKSDIFSFGVLMLEIVTGRKNTSFVHLDRTFNLIGYAWELWQQGDTLELKDPTLGETCGIQQFLRSVHVALLCVQESATDRPTTSDMISMLLNDTISLPTPNKPAFVIGKVESKSTDESKEKDCSVNDMTVTVMEGR

SEQ ID NO: 30129 - protein, 287 aa, Oryza sativa
MPPPSPPLFLSLPSPPPPPLPHLLPSHRPAAALTLAPALSSRRVSSVCPVASQRHSDYFDPRAPPPPPPRDGYGGPAYSPPAAQGGQQNGRVFSTYSIYKGKAAMSLDPRPPQFVPLDVGRGGAAACELRDCESGAYKVVKEGFVLLQFAPAVATRQYDWTRKQVFSLSVWEMGSLLTLGPTDSCEFFHDPFKGRSDEGKVRKVLKVEPTPDGNSRFFNLSVQNRLLNIDENIYIPITKGEFAVIVSTFNYIIPHLMGWSTFTNSIKPEDSGAYTRPKSGPEYEWRR

SEQ ID NO: 30130 - protein, 271 aa, Ostreococcus tauri
MDETSSSAKATRDAKVRALFTALLTARSVREDATAVEVTEGVYVGSVGAARNARELRRMGVTHVLAVCDGAPAFSDDEGNGFIRATRAVKDSPEAPIEETFDFCYDFIRDARASGGRVLVHCFQGKSRSATICAMYMMRSLGMSYDEALEKIRAVRPCARPNSGFEKRLRALEKALAERARDGSPSKRRRRSPEIATTHRRQSEHPYDSSTRSRPRPAVRFAAHQTRALRSPTLRPSGASTPERTRDAEHAHPGSTTERSRVPVRRRVARV

SEQ ID NO: 30131 - protein, 440 aa, Triticum aestivum
MTMMAMPEAPCLCARPSLAARARRPGSGPAPRLRRWRPNATAGKGVGEVCAAVVEAATKVEDEGEEDEPVAEDRYALGGACRVLAGMPAPLGATALAGGVNFAVYSGGATAAALCLFTPEDLKADRVTEEVPLDPLMNRTGNVWHVFIEGELHNMLYGYRFDGTFAPHCGHYLDVSNVVVDPYAKAVISRGEYGVPARGNNCWPQMAGMIPLPYSTFDWEGDLPLRYPQKDLVIYEMHLRGFTKHDSSNVEHPGTFIGAVSKLDYLKELGVNCIELMPCHEFNELEYSTSSSKMNFWGYSTINFFSPMTRYTSGGIKNCGRDAINEFKTFVREAHKRGIEVILDVVFNHTAEGNENGPILSFRGVDNTTYYMLAPKGEFYNYSGCGNTFNCNHPVVRQFIVDCLRYWVTEMHVDGFRFDLASIMTRGSSLWDPVNVYGAP

SEQ ID NO: 30132 - protein, 503 aa, Gibberella zeae
MLSTSVPNNCTFSPASATPHLTINHDVAADLDSTNAFEGPEKLLEVWFAPSPSTLPPTAAANGLKAVPADTWVPMLDMVNCKVLSVLESDNMDAYLLSESSMFVFPHKIILKTCGTTTLLLGLQRMLHIAAKYGFPYHNANSPDDIQAAATPYRVFYSRKNFLFPEKQQGPHRSWKQEVKYLDDMFDGGSAYMVGKMNGDHWYLYLTSPNQQALTPPRTPESEIEGTKIPVGTSFAPIPGSYHDETLEILMTDLDQENAKQFYLSHASAVASDKMAAEAKDARKEAINSLGGLGDDVDEVDVFANDADSNMLDSVEALTTEGHALGTVVSESCGLSSVYPTSKYPDARVDAYLFSPCGFSANGVVPPPASAEGGKGEHYFTVHVTPEPQCSFASFETNVPGGQSGRTTTEIIEHVVDIFKPGRFSVTLFEAKGAAQNPYCMGDDEPTNWAAKRLVDPVRGYRRVDRIVHDFEDYDLVFRFYEREGWAGSKSARVGEPISPTFK

SEQ ID NO: 30133 - protein, 257 aa, Photorhabdus luminescens
MSEYFDPRKVWFVGAGPGDKELITLKGYRLLQQAQVVIYAGSLINTELLDYCPPEAECHDSAGLTLEQIVALMVDGVRAGKLVVRLQTGDLSLYGSIREQGEVLTEAGISFVSIPGVSAFLGAAAQLGVEYTVPEVAQSLIITRIEGRTPVPPLEQLESFAAHQTSMAIYLSVQKMRHVAARLQAGGYPATTPVAVIYKATWDESLTVRGTLADIAEKVQTAGIRKTALILVGAFLGEEYHYSKLYDAGFSHEYRRA

SEQ ID NO: 30134 - protein, 207 aa, Zea mays
  misc_feature (48)..(48): Xaa can be any naturally occurring amino acid
  misc_feature (133)..(133): Xaa can be any naturally occurring amino acid
YRQIMNKPYPKSRYCRGVPDPNIMIYYVGMMRKDVDDFPYCGHLVSCXKENVSTEDLDDARIVCYKYMINSAGKDDFHLLLRLHPFHVLLIINMISCAAADKILTAMMSAFVKTHDTCATMDIVHVLLSARCXDNNAAHASEALLRANFKFPARRKIIVSRKWCFSKFIRGDYLKYNSDDRIVPDDVNAKLLVNHGRFDKSAPAKDF

SEQ ID NO: 30135 - protein, 427 aa, Rhodococcus erythropolis
MSIVIIGSGQAGFEAAVSLRSHGFSGTITLVGDEPGVPYQRPPLSKAYLHSDPDRESLALRPAQYFDDHRITLTCGKPVVRIDRDAQRVELIDATAIEYDHLILATGARNRLLPVPGANLPGVHYLRTAGEAESLTSSMASCSSLVVIGAGFIGLEVAAAARKKGLDVTVVEAMDRPMARALSSVMSGYFSTAHTEHGVHMRLSTGVKTINAADGRAAGVTTNSGDVIHADAVVVGIGVVPNIELAALTGLPVDNGIVVDEYLRTPDENISAIGDCAAYPIPGKAGLVRLESVQNAVDQARCLAAQLTGTSTHYRSVPWFWSEQYESKLQMAGLTAGADTHVVRGSVDSGVFSIFCFLGTRLLGVESVNKPRDHMAARKILATEMPLTPEQAADTDFDLKLAIARHKDTHKDEVASADIGERQVVAS

SEQ ID NO: 30136 - protein, 360 aa, Solanum tuberosum
MEMDLPVSAIGFEGFEKRLEISFVEPGLFADPNGKGLRSLSKAQLDEILGPAECTIVDNLSNDYVDSYVLSESSLFVYSYKIIIKTCGTTKLLLAIPPILRLAETLSLKVQDVRYTRGSFIFPGAQSFPHRHFSEEVAVLDGYFGKLAAGSKAVIMGSPDKTQKWHVYSASAGSVQSNDPVYTLEMCMTGLDREKASVFYKTEESSAAHMTVRSGIRKILPKSEICDFEFEPCGYSMNSIEGAAVSTIHITPEDGFTYASFESVGYNPKTMELGPLVERVLACFEPAEFSVALHADVATKLLERICSVDVKGYSLAEWSPEEFGEGGSIVYQKFTRTPYCESPKSVLKGCWKEEEKEGKE

SEQ ID NO: 30137 - protein, 629 aa, Desulfovibrio desulfuricans
MCGIAGYCGACGVADTTEKECAGRLEALLAGIVHRGPDDAGITCAHNVAIGMRRLSIIDLAGGHQPMLSGDGRYALVFNGEIYNFRELRSELAEAGYSFATNSDSEVLLKGYMAWGRGVLDRLDGMFAFAVHDRHAGTVFLARDHLGIKPLYYIHLGGVFAFCSEPAPLLELPQVRRRLDHDALAAFLSFKYVPAPDTFIKDIKKLAAGHTLEYSPRGDMLRTERYWQLQGREGSSDAGELAERLTRAVDSQMVSDVPLGVFLSGGIDSGLLTWAAAGQGGEHFTGGYTVAFDETGRKKGLRAGGSFDESRLAALSAAHLGVPLSSTTLASPAQATLDDWIRRFQEPFANTSIPANFLLCQWVARHVKVALNGSGADELFGGYDRYYAVHPPAALRALHCAAPLLRRVADMLPVGGGKNSLVHRARRYLAGCALAPAQKHAGSIRLFTDTQLAAIAPGVVPATFVQDAFAGAPQGSLLYKATWTDMQTMLPDDYLTLVDRTSMAASLEVRVPFLARDFVQYAFSLPPAAKIAGWKKKTALRALAAKHLPEDIARQPKMGFESPVGRWFRDGLGEALCRQLAQSPLQNIISVRGVQALAQSHSAGQVDAAKPLLALYTLVRWMDMYRVEL

SEQ ID NO: 30138 - protein, 262 aa, Staphylococcus epidermidis
MAVISMKQLLEAGVHFGHQTRRWNPKMKKYIFTERNGIYIIDLQKTVKKVEEAYNFVKQISEEGGKVLFVGTKKQAQESVKAEAERAGQFYVNQRWLGGILTNYKTISKRIKRISEIEKMEEDGLFEVLPKKEVVELKKEYDRLIKFLGGIRDMKSMPQALFVVDPRKERNAIAEARKLNIPIVGIVDTNCDPDEIDYVIPANDDAIRAVKLLTGKMADAILEGQQGVSNEEVAAEQNINLDDKEESEQAETTEENTSVESN

SEQ ID NO: 30139 - protein, 852 aa, Streptococcus thermophilus
MNMTEKIQTYLNDPKIVSVNTVDAHSDHKYFESLEEFSEGEMKLRQSLNGKWKIHYAQNTNQVLKDFYKTEFDETDLNFINVPGHLELQGFGSPQYVNTQYPWDGKEFLRPPQVPQESNAVASYVKHFTLNDALKDKKVFISFQGVATSIFVWVNGNFVGYSEDSFTPSEFEISDYLVEGDNKLAVAVYRYSTASWLEDQDFWRLYGIFRDVYLYAIPKVHVQDLFVKGDYDYQTKAGQLDIDLKTVGDYEDKKIKYVLSDYEGIVTEGDASVNSDGELSVSLENLKIKPWSAESPKLYDLILHVLDDDQVVEVVPVKVGFRRFEIKDKLMLLNGKRIVFKGVNRHEFNARTGRCITEEDMLWDIKVMKQHNINAVRTSHYPNQTRWYELCDEYGLYVIDEANLETHGTWQKLGLCEPSWNIPASEPEWLPACLDRANNMFQRDKNHASVIIWSCGNESYAGKDIADMADYFRSVDNTRPVHYEGVAWCREFDYITDIESRMYAKPADIEEYLTTGKLVDLSSVSDKHFASGNLTNKPQKPYISCEYMHTMGNSGGGLQLYTDLEKYPEYQGGFIWDFIDQAIYKTLPNGSEFLSYGGDWHDRPSDYEFCGNGIVFADRTLTPKLQTVKHLYSNIKIAVDEKSVTIKNDNLFEDLSAYTFLARVYEDGRKVSESEYHFDVKPGEEATFPVNFVVEASNSEQIYEVACVLREATKWAPKGHEIVRGQYVVEKISTETPVKAPLNVVEGDFNIGIQGQNFSILLSRAQNTLVSAKYNGVEFIEKGPKLSFTRAYTDNDRGAGYPFEMAGWKVAGNYSKVTDTQIQIEDDSVKVTYVHELPGLSDVEVKVTYQVD

SEQ ID NO: 30140 - protein, 175 aa, Pseudomonas putida
MSLHDLQTLPGVTAQPDAATAQFVFNHTMLRVKDIEKSLDFYTRVLGFRLVDKRDFPEAAFSLYFLALVDPAQIPADDTARHQWMKSIPGVLELTHNHGTENDADFAYHNGNTDPRGFGHICISVPDVRAACARFEELEVPFQKRLQDGRMNHLAFVKDPDGYWVEVIQPTELEG

SEQ ID NO: 30141 - protein, 447 aa, Ralstonia eutropha
MNSPSLDAFLAGVARRDPGQPEFLQAVKEVMMTLWPFVERHPRYADQALLERLVEPERVIQFRVAWTDDQNRVQVNRAFRVQHSSAIGPYKGGMRFHPTVNLSVLKFLGFEQTFKNALTTLPMGGGKGGSDFDPKGKSDAEVMRFCQALVTELYRHLGPDTDIPAGDIGVGAREVGFMAGMMKKLSNQSACVFTGKGLAFGGSLMRPEATGYGTVYFAQEMLHRRGMDFDGLRVLLSGSGNVAQYAAEKAIELGAKVLTLTDSGGVLHYPEGMTTEQLAEVMAFKNEERGRLSDFAARHGMKFEAGRTPWHVPADVALPCATQNELDGNDAETLLGNGVICVAEGANMPSTLEAVDRFVDAKILYAPGKASNAGGVATSGLEMSQNAMRLSWHHAEVDEKLHAIMKDIHQNCIHHGQKDGGYVNYVEGANIAGFVKVADAMLAQGVI

SEQ ID NO: 30142 - protein, 453 aa, Unknown
  Nocardioides sp. JS614
MPPSTPAVLWFRRDLRLADNPALVEAAADGPVLPLFVLDPVLWGPAGAARRAYLGASLRALDASLRERGTRLSVVRGDPARLVPRAARAVGAARVHVAADFGPYGSRRDGAVEQALTGAGAELVRTGSPYAVAPGRVTNTAGAPYRVFTPFHRAWAEHGWRGPVGVPEGTGWLRLAEGTAEIPDPALPDGLTLPAAGEAAARRRWAEFLDRVDEYAEDRDRPAVDGTSQMSAHLKWGEIHPRTMLADLARRRGAGAATYRKELAWREFYADVLHARPETARQYLRPEFARMRYDEPGEHLDAWRHGRTGFSVVDAGMRQLRATGWMHNRVRMITASFLVKDLHLEWQLGARHFLRWLVDGDLASNQHGWQWTAGCGTDAAPYFRVFNPTAQGRRFDPRGEYVRRWVPELADPDVVADPHDPSPSERQAVGYPEPIVDHAAERREALGRWERIR

SEQ ID NO: 30143 - protein, 104 aa, Lactococcus lactis
MEYNITDATFDEETKEGLVLIDFWATWCGPCRMQAPILEQLSEELDESELKICKMDVDENPATAQGFGIMSIPTLMFKKDGEEVKRIVGVQTKAQLKAVIAELS

SEQ ID NO: 30144 - protein, 564 aa, Kluyveromyces marxianus
MSEITLGRYLFERLKQVEVQTIFGLPGDFNLSLLDKIYEVPGMRWAGNANELNAAYAADGYARLKGMACVITTFGVGELSALNGIAGSYAEHVGVLHVVGVPSISSQAKQLLLHHTLGNGDFTVFHRMSSNISETTAMITDINSAPSEIDRCIRTTYISQRPVYLGLPANLVDLKVPASLLETPIDLSLKPNDPEAENEVLETVLELIKDAKNPVILADACCSRHNVKAETKKLIDITQFPAFVTPMGKGSIDEQHPRFGGVYVGTLSSPEVKEAVESADLVLSVGALLSDFNTGSFSYSYKTKNIVEFHSDYIKVRNATFPGVQMKFVLQKLLTKVKDAAKGYKPVPVPHAPRDNKPVADSTPLKQEWVWTQVGKFLQEGDVVLTETGTSAFGINQTHFPNDTYGISQVLWGSIGFTGGATLGAAFAAEEIDPKKRVILFIGDGSLQLTVQEISTMIRWGLKPYLFVLNNDGYTIERLIHGETAQYNCIQSWKHLDLLPTFGAKDYEAVRVATTGEWNKLTTDKKFQENSKIRLIEVMLPVMDAPSNLVKQAQLTASINAKQE

SEQ ID NO: 30145 - protein, 529 aa, Unknown
  Sulfitobacter sp. EE-36
MTQFDDLIRMQAAVQDRSILSLFDTADRAQTFSAQTGDMLFDFSKTNLDRDTMDALLGLVDAADVPARRDAMFAGEKINETEDRAVLHTALRNLDGGAVMVDGADVIPGVHDTLDRMRGFADQIRSSDITDVVNIGIGGSDLGPAMAVQALSPYHDGPRCHFVSNVDGAHISDTLRGLDAKTTLVIVASKTFTTIETMTNARTARAWMTENGGDPAKQFAALSTAQDKTSDFGIDADQVFGFEDWVGGRYSVWGPIGLSLMIAIGPRAFDAFLRGGQAMDRHFCAAAPHENMPMLLALVGIWHNQICGYATRAVLPYDQRLGQLPDYLQQLEMESNGKSTLMDGTAAPYHTGPVVWGAAGTNGQHAFYQLIHQGTRVIPCEFLIAANGHEPDLTHHHKLLIANCLAQSEALMRGRSLQEASELMAAKGLTGAELDRQARHRVFPGNRPSTTLSYPLLDPFTLGQIIALYEHRVFVEGVILGINSYDQWGVELGKELATSLQPIVEGAAPATDKDGSTAALVAFIAKHAD

SEQ ID NO: 30146 - protein, 140 aa, Oryza sativa
  misc_feature (19)..(19): Xaa can be any naturally occurring amino acid
  misc_feature (65)..(65): Xaa can be any naturally occurring amino acid
  misc_feature (107)..(107): Xaa can be any naturally occurring amino acid
  misc_feature (135)..(135): Xaa can be any naturally occurring amino acid
RTGGAIRNCISMQAYTTGXGLNAIMFRHIKESIVYSEMTRLYMTDMRTYTDTEFGLRGAWFAGLXCAYELCRDPYESDNGIKQSETHGGSTWLGGHVFYDTVVLKPXHVGLNERSCGCDKHDDYVNSKHAVLITXTDMSR

SEQ ID NO: 30147 - protein, 78 aa, Arabidopsis thaliana
  misc_feature (60)..(60): Xaa can be any naturally occurring amino acid
MARFTVSASNVPAALPALLFKSTVAIAAPVPGLPSLDHQKGRLRCSSETIQGIFAIMGGXVSAAATTAFKVVKSNPAM

SEQ ID NO: 30148 - protein, 458 aa, Oenococcus oeni
MSKKTYSKLVKNQELTGDVIDLTYEGLGVVKVDDFPVFIVNSLPGERIKFAITRVLNSYAFGRVLGIIKESPDRVRADHPEMIASGIAPLVNLSYPAQLEFKRKQIRQLFHKVGIDDLEILPTLGMKNPTHYRNKTVVPVKFQAGKLVTGFYRRGSHKLVPIEDYYLNDPKIDVVVGIARDVLNDFHISAYNEISREGIVRYLMVRHGYHSGQTMLAVVATKKHLPHEKEIIKEINQRIPDLTSFLLNYNPKQTNVQLGLDNRVLSGQQVIHDTLLGLDFEIGINSFYQVNPQTTAVLYTKAAELAGLKSNQLVIDAYSGIGTIGLSIARQVRKVIGVEVVVPAVEDAKKNMLANRIENAEYIAADAAEQFIKWADAGVKPDVVFVDPPRKGLTSDLIQSLGVMAPLKFVYISCNPATLARDAVLIKEQGYRISKAVLPIDQFPQTMHVESITVFEKE

SEQ ID NO: 30149 - protein, 345 aa, Oenococcus oeni
MKRARIVYNPSSGREAIQRDLLKIMKVYERAGYETSVYETTPKAFSARDEAKRAAQAGFDLIVAAGGDGTVNEVVNGISPLKKRPLMAVIPSGTTNDYARALKIPRDDLVEAAKVINKHETLKMDIGEITSGNSRLNYFMNIGALGTLSELTYEVPSMLKTLYGYLAYITKGAELITRIQSVPVRITYDEGKFEGQVSLILLALTNSVGGFEKIVPDAKLDDGKFSLLIVEKSNIAQLFNLITKALNNGSHIKDKLITYIKTSKVKVEPLSNDKMKVNLDGEFGGVAPMTFKNLQRHIEFIAVTSRMKPGSRTRAQTADEVMAKKAEEEFKTASKEIKKKVGVDK

SEQ ID NO: 30150 - protein, 370 aa, Prunus armeniaca
TNEVPSIANYDRKSEVKTFDDTKEGVKGLVDAGITKVPRIFHLPVDQYPINNTCDSEPTKTQLRIPVIDLEGLEYDNSPTKRKETVAKVGEASETWGFFQIANHGIPVDVLEEIKNGVRGFFEQDTEVKKKYYTRDRFRPVIYNSNFDLYSAPATNWRDTFLCNMAPNPPKPEDLPQVCRDILVEYSKQVMKLGKLLFELLSEALGLKPSHLNDMDCSLGLQILGHYYPPCPQPELTLGTSKHADNDFITVLLQDHIGGLQVLHQNTWIDVLPVPGALVVNIGDLLQLISNDRFRSVEHRVLANRACPRVSVACFFSTGFLALPRIYGPIKELLSEDNLPKYRETTVKDYNAHHYNKGLDGTCALTHFKL

SEQ ID NO: 30151 - protein, 151 aa, Brassica napus
  misc_feature (10)..(12): Xaa can be any naturally occurring amino acid
  misc_feature (16)..(16): Xaa can be any naturally occurring amino acid
  misc_feature (21)..(22): Xaa can be any naturally occurring amino acid
  misc_feature (32)..(32): Xaa can be any naturally occurring amino acid
  misc_feature (34)..(34): Xaa can be any naturally occurring amino acid
  misc_feature (39)..(39): Xaa can be any naturally occurring amino acid
  misc_feature (41)..(41): Xaa can be any naturally occurring amino acid
  misc_feature (47)..(47): Xaa can be any naturally occurring amino acid
  misc_feature (54)..(54): Xaa can be any naturally occurring amino acid
  misc_feature (57)..(57): Xaa can be any naturally occurring amino acid
  misc_feature (60)..(60): Xaa can be any naturally occurring amino acid
  misc_feature (75)..(75): Xaa can be any naturally occurring amino acid
  misc_feature (82)..(82): Xaa can be any naturally occurring amino acid
  misc_feature (86)..(86): Xaa can be any naturally occurring amino acid
  misc_feature (90)..(90): Xaa can be any naturally occurring amino acid
  misc_feature (92)..(92): Xaa can be any naturally occurring amino acid
  misc_feature (98)..(98): Xaa can be any naturally occurring amino acid
  misc_feature (103)..(104): Xaa can be any naturally occurring amino acid
  misc_feature (108)..(108): Xaa can be any naturally occurring amino acid
  misc_feature (110)..(111): Xaa can be any naturally occurring amino acid
  misc_feature (113)..(113): Xaa can be any naturally occurring amino acid
  misc_feature (116)..(116): Xaa can be any naturally occurring amino acid
  misc_feature (118)..(118): Xaa can be any naturally occurring amino acid
  misc_feature (123)..(123): Xaa can be any naturally occurring amino acid
  misc_feature (127)..(128): Xaa can be any naturally occurring amino acid
  misc_feature (131)..(134): Xaa can be any naturally occurring amino acid
  misc_feature (136)..(136): Xaa can be any naturally occurring amino acid
  misc_feature (141)..(147): Xaa can be any naturally occurring amino acid
MASSMLSSAXXXTSPXQATMXXPFTGLKSSAXFXVTRKXNXDITSIXSNGGRVXCMXVWXPVGKKKFETLSYLPXLTEVELXKEDXYLLXAXKWIPCXEFQLXXGLVXRXXGXPPXTXNGRYXTLGXXPLXXXXDXDQVLXXXXXXXRPQF

SEQ ID NO: 30152 - protein, 204 aa, Unknown
  Rhodococcus sp. RHA1
MTDRIARVERTTKESSITVELNLDGTGIVDVSTGVPFFDHMLTALGSHASFDLTVHAKGDIEIEAHHTVEDTSIVLGQALGQALGDKKGIRRFGDAFIPMDETLAHASVDVSGRPYCVHTGEPEHLLHSVIGGYPGVPYATVINRHVFESIALNARIALHVRVLYGRDQHHITEAEFKAVARALREAVEPDPRVTGVPSTKGSL

SEQ ID NO: 30153 - protein, 574 aa, Unknown
  Frankia sp. CcI3
MDSEPLSEPIGDHTPGPAPAMPVGGTLRDPHWFKRAVFYEVLIRGFADSNGDGTGDIRGLISRLDYLEWLGVDCLWLLPIYSSPLRDGGYDISDYFQILPEFGDLGDFVSLVDEAHRRGIRIIADLVMNHTSDAHPWFQASRSDPDGPFGDFYVWSDSDELYPDARIIFVDTEKSNWSWDPVRGQYYWHRFFSHQPDLNYDNPEVQEAMLEVLRFWLDLGIDGFRLDAVPYLYVRENTNGENLPETHEYLKRVRKEVDAKYADRVLLAEANQWPSDVVEYFGNDDECHMAFHFPLMPRIFMAVRRESRYPISEILAQTPQIPPNCQWGIFLRNHDELTLEMVTDEERDYMWAEYAKDPRMKANIGIRRRLAPLLDNSRDQMELFTALLLSLPGSPVLYYGDEIGMGDNIYLGDRDSVRTPMQWSPDRNAGFSTADPARLYLPLIMDPVYGYQALNVEAGQRMPTSFLAWTKRMIEVRKRHPVFGLGDYTELGASNPSIFAFVREFGDDRVLCVANLSRFAQPVELDLRRFEGMVPVELLGRVHFPPIGELPYLLTLPGHGHYWFAVTRPGEFTP

SEQ ID NO: 30154 - protein, 434 aa, Robiginitalea biformata
MGKSVNIFWFRRDLRLEDNRGLCEALGAGRPVLPIFIFDSEILDGLPADDPRVTFLHDRLQELRSRMQENQGSSLAIYHGKPLEIFKELASDWDVGQVFTNRDYEPYARDRDEQVGQWLSEQGIEFHTFKDQVIFEKDEVVKDDGDPYVVYTPYMKKWKQVFRDTPLATFDSAGQLGNLIAHSRLPNPDLADFGFERSAIPVPDYDMGGKLIDAYEDNRNYPAREGTSRLGPHLRFGTISIRQALGKALESSNETFWNELIWREFFMQILWHFPRTVHEAFRKEYDRIAWRNDESEFEKWREGRTGFALVDAGMRQLNASGYMHNRVRMLTASFLCKHLLIDWRWGEAYFAEKLLDYEMASNVGNWQWAAGSGVDAAPYFRIFNPMTQVDKFDKDKSYIREWIPEYGTEDYPEKMVDHKAARERCLKTYKAALD

SEQ ID NO: 30155 - protein, 489 aa, Salmonella enterica
MGSKTKTTEAPALRRELKARHLTMIAIGGSIGTGLFVASGATISLAGPGGALFSYILIGLMVYFLMTSLGELAAYMPVSGSFATYGQNYVEEGFGFALGWNYWYNWAVTIAVDLVAAQLVMGWWFPDTPGWIWSALFLCVIFLLNYISVRGFGEAEYWFSLIKVATVIIFIIVGVAMIIGIFKGVEPVGWSNWTTGDAPFAGGFAAMIGVAMIVGFSFQGTELIGIAAGESENPEKNIPRAVRQVFWRILLFYVFAILIISLIIPYTDPNLLRNDVKDISVSPFTLVFQHAGLLSAAAIMNAVILTAVLSAGNSGMYASTRMLYTLACDGKAPRIFAKLSRGGVPRNALYATTVIAGLCFLTSMFGNQTVYLWLLNTSGMTGFIAWLGIAISHYRFRRGYVLQGYDVNDLPYRSGFFPLGPIFAFVLCLIITLGQNYEAFLKDTIDWGGVAATYIGIPLFLLIWFGYKLIKGTHFVRYSEMHFPERVKK

SEQ ID NO: 30156 - protein, 118 aa, Glycine max
  misc_feature (97)..(97): Xaa can be any naturally occurring amino acid
MDDMPLPALFEQARKIHAAATDSGADQEVVNYTRGSFIFPSAQPYPHRNFSEEVAILDGYFGKLGAGSNAYILGGQDKAQNWHVYSASADSVTQCDXNSGIRKILPDSEICDFDFEPC

SEQ ID NO: 30157 - protein, 887 aa, Ostreococcus tauri
MIGFSRGRSVTPRRGRNVTNILLGRRDVWGVPVRVEKRLGGAGLIVLRDVGSGDELHGGRFLIACQRRGTLPASERSTEGAGGSTLWSATGVVGDDVCPDEFYERPAERALTSYEDIGEAAFGKLGRNFITSVLYTELIGTAGLFFILEGDHLATLFHAKGKEELFACAAALFMVPTTWLFDLSKLSYVGALGLYASTVLTGVVSYELIHQYTTTGSLPHLAETTFVNWSTFPVSFGLLAFVYAGHAVFPAIYASMEKPEEYEKMLDESYIVVGLNCLALGCAGYALFGNEVSDQVTLSLDTGALATLAFGLTAINPFAKFALTLDPVAKGVDSKLGFRVRDSKRADTRRGHQTSILRCWHVTRRRRTHALRLCHVPFDVLPPDVWRRALSGRTLAQLRHPRYRFHVRRLGYSRGVPIRLGNQRLRRQKASSSDSWRVGHASDSLSRYNGHARRLLRDAAPTRAWDAAGRFLDALDGSLADASANGCVLHEFNSLPNVETVDVSVRLDYHAMAKNGNLKRLGVMCDARSERGSGEAWCLGLERSTAFERHRKWWRRLSEAYEDGRHPYWLSEYLEFDMHANEMNPTASVFIETTPMVNRRQAEYVPALREYLEAIEETASERLYENIQAVIDAAMGDGFDTHMWAAGIMFSRSTKTASGTIDSVRVLIHFMRHTPRNGAKDEEEDGYRSEKTRQMVRLLEILNWTGDFDEFDRIDNYFLDDGGLGSVLQLDVLNRAPTASDPSIIGPRVGVEITIGVADPTKNIMPRLNSLVDDGLVAPMWWSNFTAALCEPGPPRTDASNARALLRRPCAIRRRTAADKRDLTKNDGSGFHPPLTVAVSHLKFIVQPGRSLYVKPYVTTQAPFAWCLDDKAHAEPESLPVYNQCAR

SEQ ID NO: 30158 - protein, 150 aa, Arabidopsis thaliana
  misc_feature (112)..(112): Xaa can be any naturally occurring amino acid
MAPKAEKKPAEKKPASEKPVEEKSKAEKAPAEKKPKAGKKLPKEAGAGGDKKKKMKKKSVETYKIYIFKVLKQVHPDIGISSKAMGIMNSFINDIFEKLAQEASKLARYNKXPTITSREIQTAVRLVLPGELAKHAVSEGTKAVTKFTSS

SEQ ID NO: 30159 - protein, 224 aa, Prunus persica
MTVEMHAGLASEGGSKLKMLISYVDNLPTGDEQGLFYALDLGGTNFRVIRVQLGGKEKRVVKQEFDEVSIPPNLMTGTSEALFDFIAEALAKFVATEGEGFHPAPGRQRELGFTFSFPVWQTSIASGTLIRWTKGFNIEDAVEQDVVGELTKSVEKIGLDMRVTALVNDTIGTLAGGRYHNQDVIAAVILGTGTNAAYVERAHAIPKWHGLLPKSGEMVINMEW

SEQ ID NO: 30160 - protein, 62 aa, Protea cryophila
MPGQWEYQVGPSVGIEAGDHIWCSRYLLERITEQAGVVLTLDPKPIEGDWNGAGCHTNYSTK

SEQ ID NO: 30161 - protein, 556 aa, Unknown
  Photobacterium sp. SKA34
MCSVFGILDIKSDAAALRPIALEMSKKLRHRGPDWSGIYASEHAILAHERLAIVGLNSGAQPIYSPDKKLILAVNGEIYNHKEIRARYEGKYDFQTDSDCEVILALYQDMGEELLEELNGIFAFVLYDEEKDTYLVGRDHIGIIPLYQGSDENGNYYVASEMKALVPVCKTVSEFPPGSYYGSADAEPQRYYNRDWNEYAAVQGNSTSKEELTEALEAAIKRQLMTDVPYGVLLSGGLDSSITSAVAKRFAAMRIEDNDQSEAWWPQLHSFAVGLEGAPDLKAAREVADKIGTVHHEMTYTIQEGLDAIRDVIYHIETYDVTTIRASTPMFLMGRKIKAMGIKMVLSGEGADEIFGGYLYFHKAPNAKEFHEETVRKLLALNMFDCARANKSLAAWGVEGRVPFLDKEFIDVAMRLNPEDKMCGNGKMEKHILRECFEHYLPESIAWRQKEQFSDGVGYNWIDTLKEVAEEKVTDQQLETAAYRFPYNTPTTKEAYAYREIFEELFPLESAAKCVPGGPSIACSSAKAIEWDESFKNAADPSGRAIAAVHNEAYKK

SEQ ID NO: 30162 - protein, 341 aa, Arabidopsis thaliana
MAAKLISTGFRHTTLPENYVRPISDRPRLSEVSQLEDFPLIDLSSTDRSFLIQQIHQACARFGFFQVKNHGVNKQIIDEMVSVAREFFSMSMEEKMKLYSDDPTKTTRLSTSFNVKKEEVNNWRDYLRLHCYPIHKYVNEWPSNPPSFKEIVSKYSREVREVGFKIEELISESLGLEKDYMKKVLGEQGQHMAVNYYPPCPEPELTYGLPAHTDPNALTILLQDTTVCGLQILIDGQWFAVNPHPDAFVINIGDQLQALSNGVYKSVWRRAVTNTENPRLSVASFLCPADCAVMSPAKPLWEAEDDETKPVYKDFTYAEYYKKFWSRNLDQEHFLENFLNN

SEQ ID NO: 30163 - protein, 435 aa, Arabidopsis thaliana
MGSWIPKLLLLQLVLLLTKHADSSSIIKYLPGFEGPLPFELETGYIGVGEEDEDQMFYYFIKSESNPKTDPLLLWLSGGPGCSSFTGLIYENGPLGFKVEAYNGSIPTLVSTTYSWTKVANIIYLDQPVGTGFSYSRNPLADIPSDTGSAKRVDEFLRKWLTKHPEYFSNPFYAGGNSYSGKMVPVIVQEISNGNCIYGKPQIRLQGYVLGSPVTDYDLDRNSRIQFAHGMALISNELYESMKRTCGGNYIFVDPLNTECLELIKDYDNCVSGIYENLILVPKCDLTSPDCHSYRSMLSDYWANNESVRRALKVVEGTTGRWERCKWTLQNNKDIKSSIPYHKKNSIQGYRSLIFSGDHDMLTPYVGTQDWIRSLNYSIIDKWRPWMILDQVAGYTTTYANKMTFATVKGGGHTLDYKPDENSILFKRWISGQLL

SEQ ID NO: 30164 - protein, 308 aa, Methanosarcina barkeri
MGRIYSDITWTIGNTPLVRLNRITEGLHADVLAKVESFNPMGSVKDRIGLAMIEKAELEGKIKKGTTVIEATSGNTGIGLACVCAARGYKLILVMPETMTVERRKLLKALGAELVLTPGTEGMKGAVNKAEQMAADDPSLYFIAQQFQNPANPEIHRRTTAEEIWRDTDGKADVIVAGVGTGGTITGVASVLKKRKPAFKAIAVEPAESPVLSGGSPGPHKIQGIGAGFIPDVLQLDLVDEVIRVTGDNAAAMSRRLAKEEGILAGISSGAATYAALQVAAREEMNGKTIVVILPDTGERYLSTDLFD

SEQ ID NO: 30165 - protein, 146 aa, Solanum tuberosum
MAPKAEKKPAEKKPAEEKKSTVAEKAPAEKKPKAGKKLPKDAASGEKKKKKAKKSVETYKIYIFKVLKQVHPDIGISSKAMGIMNSFINDIFEKLAQESSRLARYNKKPTITSREIQTAVRLVLPGELAKHAVSEGTKAVTKFTSS

SEQ ID NO: 30166 - protein, 463 aa, Bacillus halodurans
MTKQATNAVLKKGQRFPLTIKRLGINGEGVGYFKRHVVFVPGALPGEEVVVEVTDVKPRFAEASIRKIRKSSPDRISPPCPVYDQCGGCQLQHLSYEATLKEKREIVKQAFERHTTLRADTLTILPTIGMEDPWAYRNKSQLQLKTEKGQVKAGLYVMNTHKLVDLSSCLVQHDATNEASEVVKQIVQDLQIPTYNERKRTGILRSVVSRVGFETGELQVILVTTKKDFPKKDLLVEEIKSRLPHVKSLQQNINPKKTSLIMGDETISLFGEETIEETLGDISFSLSARAFFQLNPKQTVKLYNEVKRAAALTGKEKVIDAYCGVGTIGLWLADQAREVRGMDVIAEAIEDAKENAKRQGITNVQYEVGKAEKIIPSWVRSSWIPDVIVVDPPRTGCDDQLLKTIKQTKPKRIVYVSCNPSTLAKDVEQLQRSGYKVKNIQPVDMFPWTAQVESCTLLVYEGK

SEQ ID NO: 30167 - protein, 852 aa, Streptococcus thermophilus
MNMTEKIQTYLNDPKIVSVNTVDAHSDHKYFESLEEFSEGEMKLRQSLNGKWKIHYAQNTNQVLKDFYKTEFDETDLNFINVPGHLELQGFGSPQYVNTQYPWDGKEFLRPPQVPQESNAVASYVKHFTLNDALKDKKVFISFQGVATSIFVWVNGNFVGYSEDSFTPSEFEISDYLVEGDNKLAVAVYRYSTASWLEDQDFWRLYGIFRDVYLYAIPKVHVQDLFVKGDYDYQTKAGQLDIDLKTVGDYEDKKIKYVLSDYEGIVTEGDASVNGDGELSVSLENLKIKPWSAESPKLYDLILHVLDDDQVVEVVPVKVGFRRFEIKDKLMLLNGKRIIFKGVNRHEFNARTGRCITEEDMLWDIKVMKQHNINAVRTSHYPNQTRWYELCDEYGLYVIDEANLETHGTWQKLGLCEPSWNIPASEPEWLPACLDRANNMFQRDKNHASVIIWSCGNESYAGKDIADMADYFRSVDNTRPVHYEGVAWCREFDYITDIESRMYAKPADIEEYLTTGKLVDLSSVSDKHFASGNLTNKPQKPYISCEYMHTMGNSGGGLQLYTDLEKYPEYQGGFIWDFIDQAIYKTLPNGSEFLSYGGDWHDRPSDYEFCGNGIVFADRTLTPKLQTVKHLYSNIKIAVDEKSVTIKNDNLFEDLSAYTFLARVYEDGRKVSESEYHFDVKPGEEATFPVNFVVESSNSEQIYEVACVLREATEWAPKGHEIVRGQYVVEKISTETPVKAPLNVVEGDFNIGIQGQNFSILLSRAQNTLVSAKYNGVEFIEKGPKLSFTRAYTDNDRGAGYPFEMAGWKVAGNYSKVTDTQIQIEDDSVKVTYVHELPGLSDVEVKVTYQVD

SEQ ID NO: 30168 - protein, 175 aa, Unknown
  uncultured archaeon GZfos26D8
MGKKPARKYTKVTGHAYVRKKYMGGIPGSKIALFDMGNLSMGMDFPVALSLVAKEACQIRHNALEAARIFANRYLVKEVGRNNFYLKIRPYPHHVLRENKIASGAGADRVSSGMRHAFGKAVSSAARVKPGQRILSVGVEAQNFDDAKEALRRASYKLPTPCRFIIDKGEELLGV

SEQ ID NO: 30169 - protein, 60 aa, Glycine max
MLMFPGQTSRHGKIAIPDGYIQLTENDEFAYQEMLIHLALCSIPNPKKGFCSFFLFLTCT

SEQ ID NO: 30170 - protein, 261 aa, Thermosynechococcus elongatus
MISRNTAAGVYFVGAGPGDPELLTLKGQRLLQEADVILYADSLVPTGILQFAPPSTLCIPTAALTLEEIIPLMVEAVQAGKKVVRLQSGDPSLYSAIHEQICRLAEAGIAVEVVPGISAYQLAAARLKVELTLPELVQTIILTRASGRTRVPPTEELASLAAHKASLCLYLSANCIQRAQRDLLQHYPPETLVAVGYRLGWPDEQLWLVPLRDIAAFSQQQRLTRTTLYLISPALAVQQQGSDAWRSCLYSPEHHHLFRPH

SEQ ID NO: 30171 - protein, 701 aa, Staphylococcus epidermidis
MSQEKKVFKTEWAGRSLTIETGQLAKQANGAVLVRYGDTVVLSTATASKEPRDGDFFPLTVNYEEKMYAAGKIPGGFKKREGRPGDEATLTARLIDRPIRPLFPKGYRHDVQIMNIVLSADPDCSPEMAAMIGSSMALSVSDIPFQGPIAGVNVGYIDGKYVINPSVADKEISRLDLEVAGHKDAVNMVEAGASEITESEMLEAIFFGHEEIKRLVAFQQEIIDHIQPIKQEFVPVERDEDLVEKVKSLTEDKGLKDTVLTFDKQQRDENLDALKEEVVGHFLDEEDPENETLVKEVYAILNDLIKEEVRRLIADEKIRPDGRKVDEIRPLESEVGLLPRAHGSGLFTRGQTQALSVLTLGALGDYQLIDGLGPEVEKRFMHHYNFPNFSVGETGPVRAPGRREIGHGALGERALRYIIPDTQDFPYTIRIVSEVLESNGSSSQASICGSTLALMDAGVPIKAPVAGIAMGLVTRDDSYTILTDIQGMEDALGDMDFKVAGTKDGITAIQMDIKIDGLTREVIEEALEQARQGRLAIMDHMLHTIEQPREELSAYAPKVVTMSINPDKIRDVIGPGGKKINEIIDETGVKLDIEQDGTIFIGAVDQAMINRAKEIIEDITREAEVGQVYHAKVKRIEKYGAFVELFPGKDALLHISQISQERINKVEDVLKIGDTIEVKITEIDKQGRVNASHKVLEQSKN

SEQ ID NO: 30172 - protein, 87 aa, Zea mays
MSSGGRRGRISDDEINELISKLQALLPESSRRRNASRSSASKLLKETCAYVKSLHREVDDLSERLSGLMATMDNDSPQAEIIRSLLR

SEQ ID NO: 30173 - protein, 249 aa, Listeria monocytogenes
MAEVHFVGAGPGDKELITLKGYQLLKEADVVIYAGSLVNPELLEYCKASCEIHNSASMNLIEIIDCMEAGVTAGKEVVRLQTGDFSIYGSIREQVEEMKKRSIPFTCTPGVSSFLGAASSFGVEYTVPEVSQSVIITRMAGRTPVPSRESLRSYAAHQTSMVIFLSVQGIRKVVSELIKGGYKPETPAAVIYKATWAEEKKVTGTLEDIAEKVTEAGITKTALIMVGDFLGEEFYYSKLYDKDFKHEYR

SEQ ID NO: 30174 - protein, 735 aa, Bacillus halodurans
MDTNNTGKCPFHHGATTSPKSSGTTNNDWWPNALNLNILRQHDKKSNPMGEEFDYAEEFSKLDYDALKQDVRDLMRDSQDWWPADFGHYGPFFIRMSWHAAGTYRIGDGRGGGGTGNQRFAPLNSWPDNGNLDKARRLLWPIKQKYGNKISWADLLVLAGNVAIEDMGGPVIGFGAGREDIWHPEEDIYWGSEKEWLTGDKRYSGDRELENPLAAVEMGLIYVNPEGPDGKPDPIKAAHDIRETFGRMGMNDEETVALIAGGHTFGKAHGAGNPDHVGPEPEAAPIEAQGLGWQNTYGSGKGRDTITSGLEGAWTANPTQWDNGFFDLLFGYEWWLTKSPAGAYQWQAVDPDEKDLAPDAEDPSVKVPTVMLTTDLALRHDPEYEKISRRFHKNPDEFADAFARAWFKLLHRDMGPKARYLGPEVPAEDFIWQDPVPTVDYELTDAEVEELKAKILDSGLTVSELVTTAWASASTFRNSDKRGGANGARIRLAPQKDWEVNQPEQLEKVLSVLENIQSQLDKKVSIADLIVLGGSAAVEKAAKEAGFDVTVPFAPGRGDATQEQTDVEGFAVLEPVSDGFRNYQKKEYSVSPEELLIDKAQLLDLTAPEMTALIGGMRALGANYGGTQHGVFTDCVGTLTNDFFVNLLDMGIEWKPVDYNLYEGRDRKTGEVVRTATRVDLVFGSNSILRAIAEVYAQDDNKGKFVEDFIAAWVKVMNADRFDLKLNKKAQLTSK

SEQ ID NO: 30175 - protein, 467 aa, Synechococcus sp.
MALQQFGLIGLAVMGENLALNIERNGFSLTVYNRTAEKTEAFMADRAQGKNIVPAYSLEDFVASLERPRRILVMVKAGGPVDAVVEQLKPLLDPGDLIIDGGNSLFTDTERRVKDLEALGLGFMGMGVSGGEEGALNGPSLMPGGTQAAYEAVSRSVPTIAAQVDDGPCVTYIGPGGSGHYVKMVHNGIEYGDMQLIAEAYDLLKSVAGLNASELHDVFAAWNKTPELDSFLIEITADIFTKVDDLGTGQPLVELILDAAGQKGTGRWTVETALEIGVAIPTIIAAVNARILSSIKAERQAASEILSGPITEPFSGDRQAFIDSVRDALYCSKICSYAQGMALLAKASQVYNYGLNLGELARIWKGGCIIRAGFLNKIKQAYDADPTLANLLLAPEFRQTILDRQLAWRRVIAIAAERGIPVPAFSASLDYFDSYRASPAQNLTQAQRTTCAHTYKAPIALLFHAMF

SEQ ID NO: 30176 - protein, 195 aa, Unknown
  Frankia sp. CcI3
MARTARIERKTLESDVLVELDLDGTGISSSDTGVPFFDHMLSQLGKHGGFDLTVRTRGDLHIDAHHTVEDTSIAFGSALREALGDKAGIRRFGDATVPLDEALAQAAVDLSGRPYCVHVEPDLVGMIGTYDTTLTRHIFESITASARLALHVRVLSGRNAHHVVEAQFKAVARALRDAVALDARVAGIPSTKGVL

SEQ ID NO: 30177 - protein, 131 aa, Bacillus cereus
MKIALIAHDKKKNDMVSFAYAYKPIFEQHELFATGTTGLRIMEATGLVITRYQSGPLGGDQEIGAMIAKNDLDMVIFFRDPLTAQPHEPDVNALLRLCDVYAIPLATNMASAEMLMHALERGDLDYRKLRK

SEQ ID NO: 30178 - protein, 183 aa, Myxococcus xanthus
MSQNLYDIPLKSIDGAPQSLGQFKGKVLLVVNVASKCGLTPQYEGLEKLYERKRAEGFEVLGFPANNFLGQEPGSESEIKAFCTLTYDVKFPLFSKISVVGADKHPLYHALTGAIPDAVGEGPMRSRLQGYGITANPVPEVQWNFEKFLVGRDGRVAARFAPDVAADDARLLSAIDAELAKQA

SEQ ID NO: 30179 - protein, 152 aa, Salmonella enterica
MELTTRTLPTRKHIALVAHDHCKQMLMNWVERHQPLLEKHVLYATGTTGNLIQRATGMDVNAMLSGPMGGDQQVGALISEGKIDVLIFFWDPLNAVPHDPDVKALLRLATVWNIPVATNVSTADFIIQSPHFNDAVDILIPDYARYLAERLK

SEQ ID NO: 30180 - protein, 718 aa, Bacillus subtilis
MVSIRRSFEAYVDDMNIITVLIPAEQKEIMTPPFRLETEITDFPLAVREEYSLEAKYKYVCVSDHPVTFGKIHCVRASSGHKTDLQIGAVIRTAAFDDEFYYDGELGAVYTADHTVFKVWAPAATSAAVKLSHPNKSGRTFQMTRLEKGVYAVTVTGDLHGYEYLFCICNNSEWMETVDQYAKAVTVNGEKGVVLRPDQMKWTAPLKPFSHPVDAVIYETHLRDFSIHENSGMINKGKYLALTETDTQTANGSSSGLAYVKELGVTHVELLPVNDFAGVDEEKPLDAYNWGYNPLHFFAPEGSYASNPHDPQTRKTELKQMINTLHQHGLRVILDVVFNHVYKRENSPFEKTVPGYFFRHDECGMPSNGTGVGNDIASERRMARKFIADCVVYWLEEYNVDGFRFDLLGILDIDTVLYMKEKATKAKPGILLFGEGWDLATPLPHEQKAALANAPRMPGIGFFNDMFRDAVKGNTFHLKATGFALGNGESAQAVMHGIAGSSGWKALAPIVPEPSQSINYVESHDNHTFWDKMSFALPQENDSRKRSRQRLAVAIILLAQGVPFIHSGQEFFRTKQGVENSYQSSDSINQLDWDRRETFKEDVHYIRRLISLRKAHPAFRLRSAADIQRHLECLTLKEHLIAYRLYDLDEVDEWKDIIVIHHASPDSVEWRLPNDIPYRLLCDPSGFQEDPTEIKKTVAVNGIGTVILYLASDLKSFA

SEQ ID NO: 30181 - protein, 153 aa, Zea mays
  misc_feature (16)..(16): Xaa can be any naturally occurring amino acid
MVKSTDGGGGSSSSFXPSVAPFLRKCYDMVDDSTTDSIISWSPSADNSFVILDTTVFSVQLLPKYFKHSNFSSFIRQLNIYGFRKVDADRWEYANDGFVRGQKDLLKNVIRRKNVQSSEQSKHESTSTTYAQEKSGLWKEVDILKGDKQVLAQ

SEQ ID NO: 30182 - protein, 250 aa, Thermotoga maritima
MSMRDVLISRLIVERYFEKLRNSLELDVAIVGAGPSGLTAAYELAKNGFRVAVFEERNTPGGGIWGGGMMFNEIVLEKELENFLKEVEIEYEVKEDHIVVDSVHFASGLLYRATKAGAIVFNNVSVEDVAVQNGRVCGVVVNWGPTVRLGLHVDPITVKASFVVDGTGHPANVVSLLAKRGLVEMKTEFPMDADEAEKFVVDNTGEIFPGLLVSGMAVCAVHGGPRMGPIFGGMILSGQKVARIVSERLR

SEQ ID NO: 30183 - protein, 137 aa, Brassica napus
RDAWAQAWALARQLNLRPRQVEVWFQNRRARTKLKQTEVDCEFLKKCCETLTDENRRLQKELQDLKALKMSQPFYMHMPAATLTMCPSCERLGGGGGGAAGGGGGTAEVNGGTAKGAFSVVTKPRFFNPLTSPSTAC

SEQ ID NO: 30184 - protein, 556 aa, Ostreococcus tauri
MMRQRETKEAVARRTLAEFETQIEETARRTGDATTRARVERMLKRLPKQYAMDVNFIEDVLAHAELLGRVEQELQAMGVSSVYCSVREVEVGRAAFGSHEDMMDTDGGIEQLNVTADNGIPIRADSPAGKPRGPTFGSSLQMTSSLGGDPSRGSAGMYEVAVAAGNKPRLLSRVSAVLFDVGLNIAEAHVFCTDDGLALDIFVVTGWKRGEEAAVGHAVQTALDAADFSDIVPASRNASAATPSADEGRMSAGSHGRSTSNDSVSIDGGEWELKESQLVFNEKIASGAFEVAIKVLKSNAQEGNAGNETMREFAQELSILRRVHHKHIIQLIGALTKQKTMCLVTEFMHGGNVLQFVQEHALKLHEIIRFSLGVAMGLDYLHKINIIHRDIKTANLLLDENSVVKIADFGVARLQPTDGSTMTAETGTYRWMAPEVIAHGFYNEKADVYSYGIMVWELESGGEVPYPGYTPLQAAVGVVQRGLRPAISTSCNPKLAQVMQSCWLADATQRPGFEQIISLLKSIDTQKAETDGKHGFFDRLRSVSFKSKKNAPARSS

SEQ ID NO: 30185 - protein, 224 aa, Prunus persica
  misc_feature (100)..(100): Xaa can be any naturally occurring amino acid
MTVEMHAGLASEGGSKLKMIISYVDNLPTGTEKGLFYALDLGGTNFRVLRVQLGGKVRGIISQEFTEVSIPENLMVGTSDALFDYIAAEVAKFVAKEGQXYQLPPGRQRELGFTFSFPVLQSSINSGTLIKWTKGFSIDDAVGQDVVAELSKAIEKQGLDMRVSALVNDTVGTLAGGRYVNGDVVAAVILGTGTNAAYVERAHAIPKWHGLLPKSGEMVINMEW

SEQ ID NO: 30186 - protein, 311 aa, Bacillus subtilis
MLKIVANTADLIGDTPLVRLNRLQPENAAQVYLKLEFFNPSGSVKDRAAYQMIIEAEQNGLLKPGSVIIEPTSGNTGIGLAMNAAARGYKAILVMPDTMTKERINLLKAYGAEVVLTPGEERMPGSIKKAKELAEQIPNSYIPMQFDNTANPDAHRKTTAPEIARAIEEIGKPLGAFVASSGTGGTITGTGEALKELFPDITVHVVEPAGSPVLSGGKPGAHKLVGTSPGFIPPILNEDVYDEIIKISDEDAYTTTRRLAAEEGILVGPSSGAACFAAIETAKRLSPDKVVVCMTADTGERYLSTDLWSFI

SEQ ID NO: 30187 - protein, 335 aa, Zea mays
MARQSAASMLATTTPLLLSVLANIAVVESIGVSYGMSGDNLPPASTVIGMYKDNGIPLMRIYAPDQAALQAVGGTGITVSWGAPNDVLCSLAASPAAAASWVRNNIQAYPSVSFRYVCVGNEVAGGAAQDLAPAMENVHAALAAAGLGHIKVTTSVSQAILGVYSPPSAAEFTGEARGYMGPVLQFLARTGSPLMANIYPYLAWAYNPSAMDMSYALFTSSGTVVQDGAYGYQNLFDTTVDAFYVAMGKNGGSGVPLVVSESGWPSGGGVQATPANARVYNQYLINHVGRGTPRHPGAIETYLFSMFNENQKESGVEQNWGLFYPNMQHVYPISF

SEQ ID NO: 30188 - protein, 372 aa, Geobacter metallireducens
MAEKRDYYEVLEVHRNASDTEIKKAFRKLAIQYHPDKNPGDKESEEKFKEITEAYEVLSDSQKRAQYDQFGHAGLGAGGFSSGGFGGFGAGTPFGDIFGDIFGDIFGGRPRGSRGRRGDDLQYNLELSFEEAAFGVEKEILVPFGKRCDECGGSGAKPGTEPKVCPTCRGAGQVRFQQGFFSVSKTCSHCNGEGRVVENPCPTCRGNGMVRDTKTLSVKVPAGVETGTRLKMTGEGGQGTKGGGNGDLYVAIAVKEHPIFTREDNDVICEIPISFVQAALGCEMEVPTLDGKVSMKVPEGTQSGRIFRLRGKGVPQLQGYGRGDQMVVVKVETPSNLNKRQRELLEEFARISGEDAHPMKKNFFDKVMDLFS

SEQ ID NO: 30189 - protein, 78 aa, Glycine max
  misc_feature (18)..(18): Xaa can be any naturally occurring amino acid
  misc_feature (72)..(72): Xaa can be any naturally occurring amino acid
MGTPESSREPCPDRILDXIGGAFGMGAVGGSAFHFLKGTYNSPKGSRFLGGKQAVAMNAPRLGGSFAVWGGXFSTFDC

SEQ ID NO: 30190 - protein, 471 aa, Saccharophagus degradans
MKNYITPKLLLLKLVHSKAYAAIMVSACLYAQSNSAHAELHIKLQQPTWEFLLHNQPQPTTQLSTQAQLASSESHFASKIQPLLAAQKYDAVLKAFNQRDIKNDSAALRQLRGQILLSMQRTKEAEQALLAAIELMPNLALAHRSLSMVYMVEKNYAAASKHLRKTIELGVADAQVYGQLAYVNLQQGQAASAVAGYQYALLLDSDNQQWQQGLLYALINSQAFDQAQALLEGMLQANPKDTNLWLQRGQIALKQQRPQQALSSLETALVLGENNADNIATLAQLHIQSGSANRAVTLLANNITKMVANNNKIEVIDQVCAWLAYQQQWQQLANLTQALQKNTNNIPAHYRSRFAVYAAQVAQSNGKTKHATKLLEEAVNNDPSNGEALLTLANILRSQQRTQRANLYYIRAEALADYKERALLGRAQLEIDANNYPEALRLLRLVAQLNPARTDVLANIQSLENLVRNRS

SEQ ID NO: 30191 - protein, 153 aa, Bacillus thuringiensis
MGYIEDMRNLVGNQPLILIGSHAIIVNENNEILLQLRTDFNRWGIIGGALEYNETLEDALKREVYEETGLIIKNPELFRTYSGPDFFQIYPNGDQVHGVLVVYICREFNGELVCDQTESKELRFFSLNKLPSNLPPIIERIINEFQQFNLYVK

SEQ ID NO: 30192 - protein, 337 aa, Robiginitalea biformata
MSKAKLEYIWLDGYTPTANLRSKTKIESDFSGKLEDCPIWAFDGSSTKQAEGGSSDCLLKPVAIYPDPARKNGYLVMCEVLNPDGSPHETNSRATIDSDANDDFWFGFEQEYFIMDSHTDLPLGFPHGGYPGPQGLYYCSVGGKNTHGRELVERHADYCLEAGLNFEGINQEVACGQWEFQIFAKGAKTAGDQIWVARYLLDRLTEEYGWYIEYHPKPVRGDWNGSGMHANFSNTLLRTCGSKEIYEKVCEAFRPVTKEHIAVYGDENDLRLTGQHETQSIDEFSYGVSDRGASIRIPIMTVEKGWKGWLEDRRPASNGDPYKIAARIIKTVESADV

SEQ ID NO: 30193 - protein, 852 aa, Streptococcus thermophilus
MNTTEKIQTYLNDPKIVSVNTVDAHSDHKYFESLAEFSEGEMKLRQSLNGKWKIHYAQNTNQVLKDFYKTEFDETDLNFINVPGHLELQGFGSPQYVNTQYPWDGKEFLRPPQVPQESNAVASYVKHFTLNDALKDKKVFISFQGVATSIFVWVNGNFVGYSEDSFTPSEFEISDYLVEGDNKLAVAVYRYSTASWLEDQDFWRLYGVFRDVYLYAIPKVHVQDLFVKGDYDYQTKAGQLDIDLKTVGDYEDKKIKYVLSDYEGIVTEGDASVNGDGELSVSLENLKIKPWSAESPKLYNLILHVLDDDQVVEVVPVKVGFRRFEIKDKLMLLNGKRIVFKGVNRHEFNARTGRCITEEDMLWDIKVMKQHNINAVRTSHYPNQTRWYELCDEYGLYVIDEANLETHGTWQKLGLCEPSWNIPASEPEWLPACLDRANNMFQRDKNHASVIIWSCGNESYAGKDIADMADYFRSVDNTRPVHYEGVAWCREFDYITDIESRMYAKPADIEEYLTTGKLVDLSRVSDKHFASGNLTNKPQKPYISCEYMHTMGNSGGGLELYTDLEKYPEYQGGFIWDFIDQAIYKTLPNGSEFLSYGGDWHDRPSDYEFCGNGIVFADRTLTPKLQTVKHLYSNIKIAVDEKSVTIKNDNVFEDLSAYTFLARVYENGRKVSESEYHFDVKPGEEATFPVNFVVEASNSEQIYEVACVLREATEWAPKGHEIVRGQYVVEKISTETPVKAPLNVVEGDFNIGIQGQNFSILLSRAQNTLVSAKYNGVEFIEKGPKLNFTRAYTDNDRGAGYPFEMAGWKVAGNYSKVTDTQIQIEDDSVKVTYVHELPGLSDVEVKVTYQVD

SEQ ID NO: 30194 - protein, 310 aa, Magnetospirillum magnetotacticum
MTVDLAACTTATDPLAAMAPRRILVIHNPTAGRRRIRQLEQVVAAAQALGAKVTCRETGRRGDAEDFAALASADDFDAVIAAGGDGTVNEVLNGLGAGRHSLALGVIPLGTANVLACEIGLDPDDVDLVARTIAFGPTRRIHVGLVNRRRFLLMAGAGLDAHVVECVSTALKRRAGKLAYVVESLRQAVGYDFPKLTIRADGVEYEARMVVACKGRFYGGPFIAAPDADLTSPMLELCILPNAGMAGMLRYGLALPLGKLPGLPEVRVVSARNILITGPRGAPVQGDGDIVARLPAEISIAEETVDLICP

SEQ ID NO: 30195 - protein, 418 aa, Chlamydomonas reinhardtii
MLANLRSGIQGRTTSAPQKAAFAPTRRGCAHARTGGRRTTVVVRADGDFYDLLGVPRTADKKTIKQAYRQKARKYHPDVNKEPGAEDLFKKIGEAYEVLSDDNKKAIYDKYGEAGLRGGMGGMGGGPGVEFTNPFDLFESFFGGGMGGMGGMGGMGGGFSQRSRTRAVPGEDDKVDLQLDFLEAVFGCSRELDVDRLTGCDECETTGVRKGTTPSTCPQCQGTGQVVSAVRTPLGTFQQVSLCPRCEGSGQISQPCTKCQGDGRVRETKRISLKVPAGVDAGSRLRVRGEGNSGRRGGEPGDLYVYITIKDHPELRRDGITIHSDVEISYVDAILGTQVKVTTVDGPVELKIPPGTQPGTTLLMAKRGVPRLGSPNVRGDHMVHVRVRIPKALSADERKLVEELKELQSKTKVGPFRF

SEQ ID NO: 30196 - protein, 461 aa, Kineococcus radiotolerans
MVEPTERPASREPIDFTVESLGPRTVDSPLAPRLLARRTTHHYIEETDRVLFDDTLSKVSRRDGDLEDLPSLEPTGPRKKIFFDPSKTRVGIVTCGGLCPGINNVIRGLVSELTNHYGVRRIYGFKNGYQGFIPSYGHDVVDLTPESVSDIDGEGGTILGTSRGQQDAVEVVDCLERMGISILFVIGGDGTMRGAQKISAEIKARDLKIAVVGIPKTIDNDIPFIDQSFGFQSAFSEATRSIRSAKVEARTAPNGVSIVKLMGRHSGFIACYAALAQNDADFVLIPEVPFTLAGPGGFLEKLREKVASQGHALVVAAEGAGQELFDDDGLKDASGNKKLQDVGRLLRQAITDDFAAHDLELNMRYIDPSYVIRSVPANPYDSVYCIRLAHAAVHAAMAGRTNMVVGRWRRRFVHIPIALAVSARNQVDPHGDLWWSVLEATGQPWSFGDFAPEHVSAFGGQ

SEQ ID NO: 30197 - protein, 256 aa, Methylococcus capsulatus
MTSVTMRQMLEAGVHFGHQTRYWNPKMAPFIFGARSNIHIINLEKTLPLFNDAMKYLEQVAANRGKILFVGTKKTMRKVIEEEARRCGMPYVNHRWLGGMLTNFKTIKASIARMKDLQAMRDDGRLNRFSKKEALGMMRELEKLVCNVGGIGDMDRLPDVMFIIDTGYEKNAVSEARKLGIPVVGVVDTNNSPVGIDYVIPGNDDSIRAVQLYAQSAATAILRGKASGVDFGAVADEFVEMEPETEQGATGETLGG

SEQ ID NO: 30198 - protein, 286 aa, Brassica napus
  misc_feature (216)..(216): Xaa can be any naturally occurring amino acid
CHNGHTLCSTCKVRVHNRCPTCRQELGDIRCLALEKVAESLELPCKFYNLGCPEIFPYYSKLKHESLCNFRPYGCPYAGSECGVVGDIPFLVSHLRDDHKVDMHAGSTFNHRYVKSNPREVENATWMLTVFHCFGQYFCLHFEAFQLGMGPVYMAFLRFMGDEEEARSYSYSLEVGGSGRKLTWGGTPRSIRDSHRKVRDSNDGLIIQRNMALFFXSGGDRKELKLRVTGKIWKEQHSPDSGLFMPKPIFLIVHAFSSFFFSIFENESCMMNTFTHFFFICILNIS

SEQ ID NO: 30199 - protein, 852 aa, Streptococcus thermophilus
MNMTEKIQTYLNDPKIVSVNTVDAHSDHKYFESLEEFSEGEMKLRQSLNGKWKIHYAQNTNQVLKDFYKTEFDETDLNFINVPGHLELQGFGSPQYVNTQYPWDGKEFLRPPQVPQESNAVASYVKHFTLNDALKDKKVFISFQGVATSIFVWVNGNFVGYSEDSFTPSEFEISDYLVEGDNKLAVAVYRYSTASWLEDQDFWRLYGIFRDVYLYAIPKVHVQDLFVKGDYDYQTKAGQLDIDLKTVGDYEDKKIKYVLSDYEGIVTEGDASVNGDGELSVSLENLKIKPWSAESPKLYDLILHVLDDDQVVEVVPVKVGFRRFEIKDKLMLLNGKRIVFKGVNRHEFNARTGRCITEEDMLWDIKVMKQHNINAVRTSHYPNQTRWYELCDEYGLYVIDEANLETHGTWQKLGLCEPSWNIPASEPEWLPACLDRANNMFQRDKNHASVIIWSCGNESYAGKDIADMADYFRSVDNTRPVHYEGVAWCREFDYITDIESRMYAKPADIEEYLTTGKLVDLSSVSDKHFASGNLTNKPQKPYISCEYMHTMGNSGGGLQLYTDLEKYPEYQGGFIWDFIDQAIYKTLPNGSEFLSYGGDWHDRPSDYEFCGNGIVFADRTLTPKLQTVKHLYSNIKIAVDEKSVTIKNDNLFEDLSAYTFLARVYEDGRKVSESEYHFDVKPGEEATFPVNFVVESSNSEQIYEVACVLREATEWAPKGHEIVRGQYVVEKISTETPVKAPLNVVEGDFNIGIQGQNFSILLSRAQNTLVSAKYNGVEFIEKGPKLSFTRAYTDNDRGAGYPFEMAGWKVAGNYSKVTDTQIQIEDDSVKVTYVHELPGLSDVEVKVTYQVD

SEQ ID NO: 30200 - protein, 464 aa, Xanthomonas campestris
MTVVSVEHALAGKIPEGGEVTVRGWVRTLRGSAGLAFINVTDGSCFAPIQVVATDTLPNFDEIKRLTSGCSLIAKGVLVKSQGKGQSFEIQASGVEIVGWVEDPLTYPIQPKPMSPEFLREVAHLRPRTNLFGAVTRIRNCLAQAVHRFFHQNGFNWISTPIITTSDAEGAGQMFRVSSLDMVNLPRTAQGEVDFSRDFFGKETFLTVSGQLNVEAYCLALSKVYTFGPTFRAENSHTTRHLAEFWMIEPEIAFADLAEDARLAEQFLKYLFRAVLDERGDDLAFLAERVDKNAISKLEAFINAPFEQIDYTEAVKLLQNSGKKFDFPVEWGLDLQTEHERWLTEEHIGRPVVVTNYPEHIKAFYMRLNDDGKTVAAMDVLAPGIGEIIGGSQREERLDVLDARMAQFGLDKEHYSWYRDFRRYGSVPHAGFGLGFERLVVYVCGLSNIRDAIPYPRAPGSAEF

SEQ ID NO: 30201 - protein, 651 aa, Zea mays
MMGGGLMMDQSVVFPGVHNFVDLLQQNGDKNLGFASLMPQTSSGDQCVMGEGDLVDPPPDSFPDAVEDDSDDDVEDIEELERRMWRDRMKLKRLRELQQSRGKDPMASGGGLADGSSKPRQSQEQARRKKMSRAQDGILKYMLKMMEVCRAQGFVYGIIPEKGKPVSGASDNLRAWWKEKVRFDRNGPAAIAKYQADNAVPGAENELASGAASPHSLQELQDTTLGSLLSALMQHCDPPQRRYPLEKGVPPPWWPTGDEEWWPELGIPKDQGPPPYKKPHDLKKAWKVSVLTAVIKHMSPDIEKIRRLVRQSKCLQDKMTAKEISTWLAVVKQEEELYLKMHPGARPPASTGGIASAISFNTTSSEYDVDIVDECKGDEAGNQKTAVTDPTSFNLGAAILSDKFLMPTPMKEETADVEFIQKRNAPAPAEPELMLNNRVYTCNNVQCPHSDYSYGFLDRNARNSHQYTCKYNDPITQSAENKPLPAPPQPQAFQPAFSQANQAANNLDFSLPMDGQRSIAELMNMYDTNFMTSKTMSSSDSVTIMERPNAMPQRIQMDEGFFGQGNGVFDDVNSMMQQQQQQAPPVVQQQQQQQQQQQFFIRDDTPFMSQMGDITSTAEFRFGSGFNMSSTAAAADYPGAAQKNDGTNWFY

SEQ ID NO: 30202 - protein, 493 aa, Listeria monocytogenes
MGKVMLIGAGPGDAQLLTVKGLAALQKADVIVYDRLVEPAMLQERKASCKLIYVGKEPLHHPIPQDEIERILVREAATNELVVRLKAGDPYVFGRGGEEGETLHKAGIPFEVIPGITSAIGGLAYAGIPVTHRDFASSFHVITGHLKKGRDPLDWEALARLEGTLVFLMGMTNLPNICANLLEHGQKPETGVAIVQWATRGKQLTVTGNLQTIEQKVAESGISSPALIVVGDVVSLRPQLNFFEEMPLFHTKVLLPRARAGKSMLAEQIRDLGGEVTMYPNIQVLDVAPTKTKEQLSEVSELLFTSKEAVERFFDYLAKLDLDIRSLKNSHLTAIGKQTKEAFSEKGIIPDSFIKRRSTELILEHLPRLQKNVSNLIIGSVVDTTEVNVILADVKAIEMMPLYDMRPVTERPFDLESFEQVCFSSSRSVQNLLDVLTIEEKAILQTKTILSIGRFTSATLASFGMNNFIEAESATPESLIELIQKTKLEGVPQ

SEQ ID NO: 30203 - protein, 852 aa, Bacillus anthracis
MQITKRLINKTVLLLTLIVMLSSIFSFQSVKAVSNSKTTEVIIHYKEQSGNTKDWNLWIWGENSSGKSYEFTGEDEFGKYAKINIDGDYNRLGFIIRTNEWEKDGGDRWIENIKDGRAEVWILSGDEKVYNSKPSSDLSIQKATIDSFHEITVTTNVPFNIKEKKIEMEGIKIKSISPYDINSGDITNKVKIITEQKIDLKQTYKVKIENLADTNTEIGKVIRSEEFDYLFYYGGNDLGNIYTPQHTKFRVWAPTASEAKLVTYKKWNDKIGTEINMQQGEKGTWKAELKGNQKGLYYTYKVKIGDKWTEAVDPYARAASVNGDKGAVVDLEETNPKKWNTNKKPKLKNPEDAIIYELHVRDLSIQPESGIKQKGKYLGVTEKGTKGPEGVKTGLDHMKDLGVTHVQLLPIFDYASVNEEKVNEPQYNWGYDPKNFNVPEGSYSTNPYEPTVRITELKQMIQTLHDNNLRVVMDVVYNHMYNAAESNFHKLVPGYYYRYNEDGTFANGTGVGNDTASERTMMRKFMIDSVTYWAKEYNLDGFRFDLMGIHDYETMNEIRKAVNQIDPSIILHGEGWDLNTPLAAELKANQKNAEKMKGIAHFNDNIRDGLKGSVFEEKENGFVNGKENMEDRIKKGITAGIDYDTNSSTYQDPEQVLTYVEAHDNHTLWDKLELTNPGDSEEVRKQIHKLSSSILLTSQGIPFLHAGQEFMRTKYGDHNSYKSPDSINQMDWLRRATFNNEVDYMKGLIELRKKYPAFRMTSAEQIKTHVSFIDAPKNTVTYTIEGNKHEYFTVAHNANREAVEITLPSKGPWKVLVDGKQAGSKPLYVVHDNKIKVPALSSIVLKSEKPIK

SEQ ID NO: 30204 - protein, 344 aa, Hypocrea jecorina
ASSFVTISGTQFNIDGKVGYFAGTNCYWCSFLTNHADVDSTFSHISSSGLKVVRVWGFNDVNTQPSPGQIWFQKLSATGSTINTGADGLQTLDYVVQSAEQHNLKLIIPFVNNWSDYGGINAYVNAFGGNATTWYTNTAAQTQYRKYVQAVVSRYANSTAIFAWELGNEPRCNGCSTDVIVQWATSVSQYVKSLDSNHLVTLGDEGLGLSTGDGAYPYTYGEGTDFAKNVQIKSLDFGTFHLYPDSWGTNYTWGNGWIQTHAAACLAAGKPCVFEEYGAQQNPCTNEAPWQTTSLTTRGMGGDMFWQWGDTFANGAQSNSDPYTVWYNSSNWQCLVKNHVDAIN

SEQ ID NO: 30205 - protein, 465 aa, Clostridium perfringens
MKDVVLVKSLYRNTSEYSDKKVKISGWIRTLRASNAFGFIEVNDGSFFKNVQVVFDSAKISNYKEISKLPISSSISVIGTLVETPDSKQPFEIQAEEIIVEGMSDSDYPLQKKRHTFEYLRTIAHLRPRSNAFSATFRVRSVAAYAIHKFFQDQGFVYTHTPILTGSDCEGAGEMFRVTTLDMMAPPISEEGGIDFSQDFFGKETNLTVSGQLNAECFALAFRNIYTFGPTFRAENSNTVKHAAEFWMIEPEMAFADLIDDMEVAENMLKYVIKYVMDECPEEIAFFNQFVDKGLLERLNHVVNSEFGKVTYTEAVKLLQESGKEFEYPVEWGIDLQTEHERYLTEQIFKKPVFVTDYPKDIKAFYMRLNEDGKTVAAMDCLVPGIGEIIGGSQREERLDVLKARMAELNLNEEDYWWYLELRKYGETVHSGFGLGFERLIMYITGMANIRDVIPFPRTTGTAEF

SEQ ID NO: 30206 - protein, 430 aa, Oceanobacillus iheyensis
MKITIAQAPQYIEQEVTIGAWLSNKRSSGKIAFLQLRDGTGFMQGIVVKSDVSEDVFSTSKNITQESSLYVTGKIVEDTRSDFGYEMQVSNVEVIHEANDYPITPKEHGTEFLMDHRHLWLRSKKQHAVMKIRNEIIRSTYEYFNKEGFVKVDPPILTGSSAEGTTELFHTKYFDEEAYLSQSGQLYMEAAAMALGKVFSFGPTFRAEKSKTRRHLIEFWMIEPEMAFVEHEESLQIQENYVSHIVQSVLTNCKLELSVLDRDLSKLEKIKAPFPRISYDEAIDMLKEKGFDDIEWGEDFGAPHETAIAESYDMPVFITNYPKDIKAFYMKPHPDRSDVVLCADLIAPEGYGEIIGGSQRIDDLELMEQRYEEHGLTGPAYQWYLELRKYGSVPHSGFGLGLERTVAWLSGVEHVRETIPFPRLLNRLYP

SEQ ID NO: 30207 - protein, 243 aa, Pinus pinaster
MAAHLPLFVKGSIFSLPSSTSTSSSCTYSSISHTAASPGFHSSPAAANKSVKLGTMQRMDGVRSVKHRMTSLHAKMEKRQQIKASAQAPNGTNTHPDYVPEANFYKVEAILRPWRISHVTTGLLKMGIRGVTVSDVRGFGVQAGSAERQAGSEFSKDNFVSKVKMEIVVSKDQVEAVIDAIIDEARTGEIGDGKIFVVPVADVIRVRTGERDLKPERMAGGDQRYLQVYIKRLQTATKSLLAL

SEQ ID NO: 30208 - protein, 192 aa, Brassica napus
  misc_feature (21)..(21): Xaa can be any naturally occurring amino acid
  misc_feature (29)..(29): Xaa can be any naturally occurring amino acid
  misc_feature (46)..(46): Xaa can be any naturally occurring amino acid
  misc_feature (61)..(61): Xaa can be any naturally occurring amino acid
  misc_feature (83)..(83): Xaa can be any naturally occurring amino acid
  misc_feature (98)..(98): Xaa can be any naturally occurring amino acid
  misc_feature (142)..(142): Xaa can be any naturally occurring amino acid
DHIKLFSLHSKSYISCTWFPXSKLRYLEXLLIIVGSSLFLCLWISXGQKNHQPFDPSDKTXPHNFEHSCISVTFITYAAFAIXFDKTRPMAHRDVNTXINLIVALAFVQQLFIFHFHSSDNTGVDCHYHLLLQLVVFVSLVXTLLAIALPTLLHISRHSFYDCFDKRSRWELLLNMHATVPFSPHRVCISLA

SEQ ID NO: 30209 - protein, 225 aa, Oryza sativa
MATLAKHLILCSTATSSSSSASSPTSARRRGTASQADAAAAAGERHQRGGPQSATRRLAVAASTALAATAALSARRPAAPPPAMAAEAAAVPPPPPGPGTVPRWGTRSYVRERFFEPGLTAEEAAARIRQTAEGMRTLRPMLETMSWKYVLFYVRLKSKYLDLDLTTAMFGVPEARRADYVRVANELVDNMTEFDRFVRTPKVYESYLYYEKTLKSLDDVTEFLA

SEQ ID NO: 30210 - protein, 480 aa, Thermosynechococcus elongatus
MSQQDFGVIGLAVMGENLALNVERNGFSVAVYNRTPARTEAFMAERAAGRRFKATYTLEELVASLSRPRRILAMVKAGQPVDDLIQQLKPLLEPGDILIDGGNSLYTDTERRVAEMESAGLCFFGMGVSGGEEGALNGPSLMPGGSREAYQALEPILTKIAAQVDDGPCVTYIGPGGSGHFVKMVHNGIEYGDMQLIAEAYDLLKNLLGLNHQQLHEVFKSWNETPELNSFLIEITSQIFTYIDPETHLPLVDVIVDAAGQKGTGRWTVESALEMGVAIPTITAAVNARIMSSIKAERMAAAQVLPGPAAHFSGNTEEFIGKIRDALYCSKICSYAQGMALIAKGSQELFDHQLNLSEIARIWKGGCIIRAGFLNKIKQAYSENPQLANLLLAPEFRQTILDKQAAWREVLVEATRAGIAVPAFGASLEYFDSYRRDRLPQNLTQAQRDFFGAHTYERIDKPGTFHTEWVPIQEAGKASV

SEQ ID NO: 30211 - protein, 355 aa, Brassica napus
GTRGEEGARNGPSLMPGGSFDAYKNIEDILLKVAAQVRDSGPCVTYIGKGGSGNFVKMVHNGIEYGDMQLIAEAYDVLKSVGKLSNEELHGVFTEWNKGELESFLVEITADIFAIKDDKGDGHLVDKVLDKTGMKGTGKWTVQQAAELSVPSPTIESSLDARFLSGLKDERVQAAKVFKEGGFGDVLTDQTVDKKQLIDDVRKALYASKICSYAQGMNLIRAKSVEKGWGLKLGELARIWKGGCIIRAIFLDRIKQAYDRNAELANLLVDPEFAKEIIERQSAWRRVVCLSINSGISTPGMSASLAYFDSYRRERLPANLVQAQRDYFGAHTYERTDVEGSFHTEWFKIARQSKM

SEQ ID NO: 30212 - protein, 388 aa, Ostreococcus tauri
MWGDAGGDGVQISEIDSGEFVPGRGGRYSVMTPEDSWNVAVGDRRAPSPAIGWHDEEGSSSDALHTEFLINPDDVRLQERIAVGGFAEVFRGTWQGTVVAVKQLLERTSEVKEKLEQEVQVLAKLRHPNLLLFMGYCVDPPLICTEFMRRGSLHTILKAGKPLEPARNHAIALAVARGMSYLHSRSPPILHLDLKSPNILVDEKWRVKIADFGLARMRQTTQMSAKSQFHGTPEWMAPEMLRAEDYDEHADSYSYGVVLWELITAHKPWEDLHPMQIVAVVGYSGRSLELPSEGFPESSHPLTALLADIFTRCARRDPSARPLFPAILTDLERARDLARARAEAAGADKTAARIPPRPDTESVDRRALGVQLEYISLADAVASTDASS

SEQ ID NO: 30213 - protein, 105 aa, Arabidopsis thaliana
MGLSRFAISNATKQILKLNSLANRNRTSSSSSDHVPKGHVAVYVGEQIEMEKKRFVVPISFLNHPSFKEFLSRAEEEFGFNHPMGGLTIPCREEVFLDLIASRLQ

SEQ ID NO: 30214 - protein, 415 aa, Geobacter sulfurreducens
MSILETFDPQVAEAIRHETERQEYNLELIASENFVSEAVLEAQGSVMTNKYAEGYPGKRYYGGCHHVDVVENLAIERAKELFGADHANVQPHSGSQANMAVYFSVLKPGDTILGMNLSHGGHLTHGSPVNFSGRFFNVVPYGVSQETETIDFNEVERLALEHKPKMIVVGASAYPRTIDFAAFRIIADKVGAVIMVDMAHIAGLVAAGLHPSPVPYAEFVTTTTHKTLRGPRGGMILCREEYAKTLNSNIFPGIQGGPLMHVIAAKAVALKEALQPEFKAYQAQIVKNAKALADELVKRGFRLVSGGTDNHLMLVNLTGTELTGKVAEESLDKAGITVNKNTVPFETRSPFVTSGFRIGTPAATTHGLKEAEMADVAGFIAEALANVDNDAKLAEIKGRVNVLMKRFPLYAHRLS

SEQ ID NO: 30215 - protein, 753 aa, Unknown
  Rhodococcus sp. RHA1
MEASESTGTTPIPVWPGSAYPLGATYDGAGTNFSLFSEVAEAVDLCLIAKDGTETRIRLDEVDGYVWHAYLPTVVPGQRYGYRIHGPWDPSAGHRCDPSKLLLDPYGKAFDGEFDGDRSLFSYDIDAPAEAAPDESEDAALLVDTDDDIEAEDEAGAELAAEPEETSAPGLPGHDSLGHTMTTVVINPFFDWAADRAPKHPYHDTVIYEAHVKGMTATHPGVPEELRGTYAGLAHPVIIDHLVDLGVTAIELMPVHQFMHDQTLLDKGLRNYWGYNTFGFLAPHTGYSSAEKPGAAVSEFKAMVRSFHEAGIEVILDVVYNHTAEGNHLGPTISFRGIDNAAYYRLVDGDAEHYMDYTGTGNSLNARHPHTLQLIMDSLRYWVTEMHVDGFRFDLASTLARELHDVDRLSAFFDLVQQDPIVSQVKLIAEPWDIGEGGYQVGNFPGLWTEWNGKYRDTVRDYWRGEPATLGEFASRLTGSSDLYEATGRRPGASINFVIAHDGFTLHDLVSYNEKHNEANGEGNNDGESHNRSWNCGVEGPTDDPEILDLRGRQSRNILATLLLSQGTPMLAHGDEMGRTQQGNNNVYCQDSELSWMDWSLADANADLVEFTKRVIALRMKNPVFRRRRFFEGTPIRSGDQTRDIAWLTPAGEEMTPEDWDSGFGKSLAVFLNGEGIPEPNHRGERVVGDSFLLCFNAHDEEIEFSTPNSDYADEWAVVLDTAVPTGAKEAVIKAGDPLQVEARSLVVLRRTA

SEQ ID NO: 30216 - protein, 954 aa, Bordetella pertussis
MSRAPDTHSDFIPRHIGPSDEDQATMLVAIGAASLDALIDEVVPPRIRSRAPLALPAARSETDVLQDLKRIAARNQIYRNYIGQGYYGTHTPNVVLRNVLENPAWYTAYTPYQPEISQGRLEALLNYQTMVADLTGLDISNASLLDEGTAAAEAMTLARRGSRSSSPVFFVSQHCHPQTLEVVRTRAEGLGIELVIGDESRGLPECFGVLLQYPHSLGGVADYRELAQAAHAQGAVVACVTDLLALALIEPPGQWGADIAVGSAQRFGVPFGFGGPHAGFMACRDAYKRNMPGRLVGVSKDAQGNPALRLALQTREQHIRREKATSNICTAQVLLAVMAGLYAVWHGPRGVRRIAERVQSLTGALRAALAGLGVKVANDTWFDTLSLETGAATPAILAAADCARINLRQVDGARLAVSLDETVTLADLQALVNVFAAGLGKDEVALAPPQASLDGIPAAVRRQGPILSHPVFSSVQSETDMLRYLRKLADKDLALDRTMIPLGSCTMKLNATAEMIPITWPEFALIHPFAPASQTPGYRELIEGLSAQLCEITGYDGISLQPNSGAQGEYAGLLAIRAYHQANGQPQRNVCLIPASAHGTNPASAQLAGMDVVVVASDANGNVDLADLRARIAQVGERLAALMITYPSTHGVFEEAVTEICDAVHEAGGQVYLDGANMNAMVGVAQPGKFGSDVSHLNLHKTFCIPHGGGGPGVGPVAVRAHLAPYLPGVLDARGRLDPEAKVGPVSAAPYGSAGILPIPYVYIALMGAEGLRRATEVAILNANYIATRLRGHYPVLYAGRNGRVAHECILDVRPLKETSGISAEDIAKRLMDYGFHAPTMSFPVAGTLMVEPTESEGLAELERFIEAMIAIRAEIAQVESGERDRDDNVLRNAPHTAQMLLAEEWHHDYPRQQAAYPVASLRENKYWPPVARVDNAYGDRNLVCACLPVEAYA

SEQ ID NO: 30217 - protein, 288 aa, Rhodopirellula baltica
MSSSVKLSLIQMRDAGSKDKSIDASIGWIEKAAAEGAQIVCLQELFATCYPCQSEDHDNFDLAESIPGPTTEALQPVAERLGIVIVAPLFERRAPGVYHNSAVVIDADGSIAGVYRKMHIPDDPLYYEKFYFIPGDLGFKVIPTRFAKLGVGICWDQWFPEAARLFALAGAEILLYPTAIGWIDEEKEEFGEGQRDAWMTAMRAHAIANGIYLGAPNRVGIEGRVEFWGSSFIASPRGEILSQGDCSSDQIVSADCQFADIDVVRTHWPFLRDRRIDAYGDLTKRWID

SEQ ID NO: 30218 - protein, 877 aa, Chlorella vulgaris
MTVLLAGEDSAHGSGSAGAAMKANGYSTEASAASPQAPAAECGKAPVEEPLQPGTDEYKLHLPVTEVLDADKGTKDEWIPRHPDLVRLTGRHPFNVEPIPSRLFESYITPPSLHYVRNHGAVPQIKWEEHRLAVNGLVSAPTTFTMDDILAMPSVDVTCTLTCAGNRRKEENMVKQTIGFNWGPSGTGCSTWTGVRVSDLLQRCGMKMPKEGARHVCFRGPKGELPKGDDGSYGTSVTWVKAMDPASDVILAYKQNGRLLTPDHGYPLRLIIPGYIGGRMIKWLEEITVTEVESQNYYHFHDNRVLPSHVDEALANSEGWWYKPDFIINDLNVQSAIGYPAHEEVVPLAAGTYAVRGYAYCGNGNKIIRCEVSLDDGKSWRLGSVTHEGQPTEYGKHWGWVWWSLEVPIAELLTTPEIICRAWDSSMNTQPNTFTWNVMGMMNNCSYRVKIHPRQTTDGRFALQFEHPTIAGPTVGGWMNRAEDVAAAAAVTVAPPPAPAGAKSFTMAEVETHTTMESAWFVVDGKVYDATPFLKDHPGGADSILLVAGTDATDEFNAIHSLKAKKQLLEYYIGELAEEGQEAAAPAPATPAPAAAIGTAVPVANGAAPAAAAPEELVALNPRKRQSFKLIEKEALSHNTRRFRFALQSPQHRFGLPVGKHVFLYAKVDGELVMRAYTPSSSDDQLGYFELVVKIYFANQHPRFPEGGKMSQYLEGMAIGDFMEVKGPLGHVHYKGRGSYTLDGTPHSASRISMIAGGTGITPMLQVIKAVLKDPKDTTQLSLLYANVSPDDILLREELDALAAKHDNFSVWYTVDKADEGWPFSTGFINEEMVKERLFPAGDDTICCLCGPPPMIKFACLPNLEKLGYKPEQCIQF

SEQ ID NO: 30219 - protein, 852 aa, Streptococcus thermophilus
MNMTEKIQTYLNDPKIVSVNTVDAHSDHKYFESLEEFSEGEMKLRQSLNGKWKIHYAQNTNQVLKDFYKTEFDETDLNFINVPGHLELQGFGSPQYVNTQYPWDGKEFLRPPQVPQESNAVASYVKHFTLNDALKDKKVFISFQGVATSIFVWVNGNFVGYSEDSFTPSEFEISDYLVEGDNKLAVAVYRYSTASWLEDQDFWRLYGIFRDVYLYAIPKVHVQDLFVKGDYDYQTKAGQLDIDLKTVGDYEDKKIKYVLSDYEGIVTEGDASVNGDGELSVSLENLKIKPWSAESPKLYDLILHVLDDDQVVEVVPVKVGFRRFEIKDKLMLLNGKRIVFKGVNRHEFNARTGRCITEEDMLWDIKVMKQHNINAVRTSHYPNQTRWYELCDEYGLYVIDEANLETHGTWQKLGLCEPSWNIPASEPEWLPACLDRANNMFQRDKNHASVIIWSCGNESYAGKDIADMADYFRSVDNTRPVHYEGVAWCREFDYITDIESRMYAKPADIEEYLTTGKLVDLSSVSDKHFASGNLTNKPQKPYISCEYMHTMGNSGGGLQLYTDLEKYPEYQGGFIWDFIDQAIYKTLPNGSEFLSYGGDWHDRPSDYEFCGNGIVFADRTLTPKLQTVKHLYSNIKIAVDEKSVTIKNDNLFEDLSAYTFLARVYEDGRKVSESEYHFDVKPGEEATFPVNFVVESSNSEQIYEVACVLREATEWAPKGHEIVRGQYVVEKISTETPVKAPLNVVEGDFNIGIQGQNFSILLSRAQNTLVSAKYNGIEFIEKGPKLSFTRAYTDNDRGAGYPFEMAGWKVAGNYSKVTDTQIQIEDDSVKVTYVHELPGLSDVEVKVTYQVD

SEQ ID NO: 30220 - protein, 292 aa, Aspergillus nidulans
MSEITHPTIKDGWFSEQSEMWPGQAMNLRVNQILHHEKSKYQDVLVFESSDYGTVLVLDNVIQCTERDEFSYQEMITHLAMNSHPNPKKVLVIGGGDGGVLREVVKHETVEEAILCDIDEAVIRVSKKYLPGMSIGFQHPNVKVHVGDGFEFLKQRQNEFDVIITDSSDPEGPAESLFQKPYFELLRDALRDGGVITTQAENQWLHLPLIADLKKACNEVFPVAEYAYTTIPTYPSGQIGFMVCCKDANRNVKEPVRTWSREEEERLCRYYNQDIHRASFVLPNFARKALGN

SEQ ID NO: 30221 - protein, 852 aa, Streptococcus thermophilus
MNTTEKIQTYLNDPKIVSVNTVDAHSDHKYFESLAEFSEGEMKLRQSLNGKWKIHYAQNTNQVLKDFYKTEFDETDLNFINVPGHLELQGFGSPQYVNTQYPWDGKEFLRPPQVPQESNAVASYVKHFTLNDALKDKKVFISFQGVATSIFVWVNGNFVGYSEDSFTPSEFEISDYLVEGDNKLAVAVYRYSTASWLEDQDFWRLYGIFRDVYLYAIPKVHVQDLFVKGDYDYQTKAGQLDIDLKTVGDYEDKKIKYVLSDYEGIVTEGDASVNGDGELSVSLENLKIKPWSAESPKLYNLILHVLDDDQVVEVVPVKVGFRRFEIKDKLMLLNGKRIVFKGVNRHEFNARTGRCITEEDMLWDIKVMKQHNINAVRTSHYPNQTRWYELCDEYGLYVIDEANLETHGTWQKLGLCEPSWNIPASEPEWLPACLDRANNMFQRDKNHASVIIWSCGNESYAGKDIADMADYFRSVDNTRPVHYEGVAWCREFDYITDIESRMYAKPADIEEYLTTGKLVDLSRVSDKHFASGNLTNKPQKPYISCEYMHTMGNSGGGLELYTDLEKYPEYQGGFIWDFIDQAIYKTLPNGSEFLSYGGDWHDRPSDYEFCGNGIVFADRTLTPKLQPVKHLYSNIKIAADEKSVTIKNDNLFEDLSAYTFLARVYEDGRKVSESEYHFDVKPGEEATFPVNFVVEASNSEQIYEVACVLREATEWAPKGHEIVRGQYVVEKISTETPVKAPLNVVEGDFNIGIQGQNFSILLSRAQNTLVSAKYNGVEFIEKGPKLNFTRAYTDNDRGAGYPFEMAGWKVAGNYSKVTDTQIQIEDDSVKVTYVHELPGLSDVEVKVTYQVD

SEQ ID NO: 30222 - protein, 869 aa, Aspergillus fumigatus
MATITQVQTQETHTVLPKSLTVVPGQITVKEISNLDLPDIPLPPPSTNPTEILAQDKGTPDNHVPRDPRLIRLTGVHPFNVEPPLTALFNEGFLTSPELFYVRNHGPVPLVRDEDIPNWEISIEGLVERPVVLNFRQILQKFNQITAPITLVCAGNRRKEQNTVRKSKGFSWGPAGLSTALFTGPLMADVLRYAKPLRQAKYVCMEGADKLPNGYYGTSVKLNWAMDPNKLIMLAHKMNGEPLRPDHGRPLRAVVPGQIGGRSVKWIKKLILTDAPSDNWYHIYDNRVLPTTVSPEMAASDPMWWRDERYAIYDLNVNSAAAYPQHNEVLDLATAGPSYTAKGYAYAGGGRRVTRVEISLNKGKSWRLANIQYAEDRYRDFDGELFGGKVDMPWRETCYCWCFWSLDIPVPDLEASDALLVRSMDEAMSVQPRDMYWSVLGMMNNPWFRVTITKQNGTLLFEHPTHPVMAGGWMERVKKAGGDLTNGNWGERQEGEILAEPEPVKEINMKKEGLNRTISLEEFKKSNEEGAQWFIVKGEVYDGKPFLEGHPGGAQSIISSIGLDVTEDFSEIHSETAKAMMPDYHIGTMDEASLKMLKEARKEEEPSKPRALFLQPRSWTKAKLAAKRDVSWDTRIFTFELEHQKQKLGLPIGQHMMIRVQDSTTKEKIIRSYTPLSDPNKEGSVDVLIKVYFPTPLVPGGKMTMALDQLPLGSMIECKGPTGRFEYLGNGRVIISGKERRVRSFKMICGGTGITPIFQVLRAVMQDPQDPTSCVVLFGNRQEEDILCRAELDAFEASDKNKCKIVHTLSKAPDTWAGRRGRIGEALLKEFAVPDDESMVLICGPEAMENSAKTILLAQGWKESNLHFF

SEQ ID NO: 30223 - protein, 90 aa, Kluyveromyces lactis
PAFVNKLWSMVNDKSNEKFIHWSTSGESIVVPNRERFVQEVLPKYFKHSNFASFVRQLNMYGWHKVQDVKSGSMLSNNDSRWEFENERHA

SEQ ID NO: 30224 - protein, 241 aa, Brassica napus
MAVATAPSLNGHFLRRPFSGVKKRRPWLLPGGANLFDSRRNRDSHLLVFASSPSPLSPNSPTDALTAESCVNTGLDLFKRGRVKDALAQFETALSLDPNPIESQAAYYNKACCHAYRGEGNKAADCLRVALRDYNLKFATILNDPDLASFRALPEFKQLQEEARLGGEDIGDSFRRDLKLISEVRAPFRGFRKFFYFAFSAAAGISTLFTIPRLIQAVRGGDGAPDLLETTGNAAINMEVS

SEQ ID NO: 30225 - protein, 478 aa, Ralstonia eutropha
MTQTPQPSSGLSHGLKQRHMTMIALGGVIGAGLFVGSGVVIKSAGPAAVLSFLITGLLVVLVMRMLGELACAMPGGGSFYEYAREAWSDRPAVGNLASFLTGWMYWYFWVIVVALEAVAGADLVRYWLPDVPNWTISLVLLVMLTLTNLISVKSFGEFEFWFASIKVAAIMVFLFVAGVYVLGLAPGAHGMNVANLTANGGFMPNGIVPVLTGAVAATGFYFGAEIVTIAAAETAEPQKAVARATNSVITRVLVFYVGSVLLVVCLVPWNATGIATPYVSALNVMGIPAAAQIMNAIVLTAVLSALNSGLYASSRMLFALTKRGDAPRSLARVSRNGVPTRAILVATLFGYGAVVMSYVSPDKVFAFLVNSYGTVAIFVYILIAVSQLRLRARLEREAPHLLKVRMWCYPYLTWLAIFGMLAIVVAMAFIPDQRTPLALGVASLGLLVSAYIVRHLFRRGVQQVVPLAEMPRPDLHEY

SEQ ID NO: 30226 - protein, 478 aa, Debaryomyces occidentalis
MVHLGPKPPQHRKGSFLDVPEYLLKELTELEGLLTVSGETLRKITDHFISELEKGLSKQGGNIPMIPGWVMDFPTGKEMGDYLAIDLGGTNLRVVLVKLGGNRDFDTTQSKFALPENMRTAKSEELWEFIAECLQKFVEEEFRNGVLSNLPLGFTFSYPASQGSINEGYLQRWTKGFDIEGVEGHDVVPMLQAAIEKRKVPIEVVALINDTTGTLVASMYTDPEAKMGLFSGTGCNGAYYDVVDNIPKLEGKVPDDIKSSSPMAINCEYGAFDNEHIILPRTKYDIQIDEESPRPGQQAFEKMISGYYLGEVLRLILLDLTSKQLIFKDQDLSKLQVPFILDTSIPARIEEDPFENLSDVQELFQEILGIQTTSPERKIIRRLAELIGERSARLSICGIAAICKKRGYKTAHCAADGSVYNKYPGFKERAAKGLRDIFQWESEEDPIVIVPAEDGLGAGAAIIAALTEKRLKDGLPLV

SEQ ID NO: 30227 - protein, 550 aa, Escherichia coli; identical to SEQ ID NO: 355

SEQ ID NO: 30228 - protein, 298 aa, Pseudomonas putida
MSQLRIATTQMPCSWNLPDNLDRAEQLVRQAAAKGAQVILLQELFATPYFCIEQNHQHQALAQPYPDSPILQRFAALAGELGVVLPLSWYERAGNAFFNSLTVADADGRLLGVYRKTHIPNAIGYQEKEYFSPGDTGFKVWDTAFGRLGIGICWDQWFPETARCLALMGAEVLLFPTAIGSEPGCAELDSRDHWQVAMRGHAAANLLPVVAANRVGEEVAASDAALAMRFYGSSFICDHKGAMLAEADRDSSGIWLHDLDLAGMREDRLSWGIFRDRRPEMYATLLTLDGTHPHSLRA

SEQ ID NO: 30229 - protein, 830 aa, Mannheimia succiniciproducens
MELNRRDFMKANAAVAAAAAAGITIPVKNVHAADDDMGIRWDKAPCRYCGTGCSVLVGTKDGRVVATQGDPDAEVNRGLNCIKGYFLSKIMYGADRVQTPLLRMKDGKFHKEGDFTPVSWDQAFTVMADKIKAILKEKKDPNAIGMFSSGQTTIFEGYAKVKLWKAGLRSNTIDPNARHCMASAAVAFLRTFGMDEPMGCYNDIEKTDAFVLWGSNMAEMHPILWSRISDRRLSSDKVKVVVMSTFEHRSFELADTPIIFKPHSDLAILNYIANYIIQNDKVNWDFVNKHTKFKRGETDIGYGLRPEHPLEVAAKNRKTAGKMYDSDFEEFKKIVAPYTLEEAHRISGVPKDQLETLAKMYADPQQNLVSFWTMGFNQHTRGVWVNHMVYNVHLLTGKISKPGCGPFSLTGQPSACGTAREVGTFVHRLPADMVVTNPKHVEIAENIWKLPKGTISNKPGFPAVQQSRALKDGKLNFLWQLCTNNMQGGPNINEEIFPGWRNPDNLIVVSDPYPSASAVAADLILPTCMWVEKEGAYGNAERRTQFWRQQVKGPGQSRSDLWQIVEFSKYFKTEEVWSEELLAQMPEYRGKTLYEVLYLNGEVNKFQTPTNVPGYINDEAEDFGFYLQKGLFEEYASFGRGHGHDLADFDTYHQVRGLRWPVVDGKETLWRYREGYDPYVKAGEEVSFYGYPDKKAIILGVPYEAPAESPDEEYDLWLCTGRVLEHWHTGTMTRRVPELHKAFPNNLCWMHPTDAKKRGLRHGDKVKLITRRGEMISHLDTRGRNKCPEGLIYTTFFDAGQLANKLTLDATDPISGETDYKKCAVKVVKA

SEQ ID NO: 30230 - protein, 834 aa, Pseudomonas stutzeri
MSLTRRQFAKANAAAIAATVAGMPIASTASNLVTEADATNLKWDKAPCRFCGTGCGVMVATRENRVVATHGDVKADVNRGINCVKGYFLSKIMYGTDRLTQPLLRMKDGKFDKQGEFQPVTWDQAFDIMEEKYKAALKAGGPEAIGMFGSGQWTIWEGYAANKLMKAGFRSNNIDPNARHCMASAAFGFMRTFGMDEPMGCYEDIEAADAFVLWGSNMAEMHPVLWTRLTDRRLSAPHVKVAVMSTFEHRSFELADIPMIFNPQTDLVILNYIANHIIQSGAVNKEFIDKHTRFAKGATNIGYGLRPTDPLELKAENAAVANTWTDIGYEDYVEFLKPYTLEHAAKESGVPAERLKALAELYADPKVKVMSFWTMGFNQHTRGVWANNMIYNIHLLTGKISEPGNSPFSLTGQPSACGTAREVGTFSHRLPADMAVTNPKHRAITEKIWKLPEGTIQEKPGFHAVDQSRKLKDGVLKVYWTQVTNNMQAGPNVMQEILPGWRNPETFVIVSDVYPTVSAQAADLILPSAMWVEKEGAYGNAERRTQFWHQLVTAPGEARSDLWQLVEFSKRFRVDEVWPAELLSKAPEFKDKTLFDVLFKNGQVDRFSNDEIAEGYANYEAEAFGFYLQKGLFEEYAEFGRGHAHDLAAFDVYHRERGLRWPVVDEKETQWRYREGYDPYVEAGSGVQFYGNADKKAIIFALPYEVPAEVPDEEYPFWLSTGRVLEHWHTGSMTQRVDELHKAVPDALVYMHPEDARKLNVRRGSVVKIVSRRGEMQGRVETRGRNKPPMGLVYVPFFDANKLINKVTLDATDPISKQTDFKKCAVKIEVVSIA

SEQ ID NO: 30231 - protein, 140 aa, Oceanobacillus iheyensis
MNIALIAHDEKKEDMIQFTTAYTHVLSKHRLFATGTTGMKISNATGLQIHRFQSGPLGGDQQIGAMIANGEMDMIIFFRDPLTAQPHEPDVSALMRLCDVHQIPLVTNIAGAEIFIHGLSRGDLKWREIIKERQEKEGTP

SEQ ID NO: 30232 - protein, 257 aa, Synechococcus sp.
MTNQRFKSTDPVNIEGWSWQPFLEDAIKRLEGLNVEPYPVPDRFLQREDQTGSKSKSIPVTTATWACKTEKFRQVRAACVSAGSAASVLNFVINPKSTYGLPFFGGDLVTFPAGHLLALDLQPAIKTDEVHTTHVWDRLIPIFERWRDQLPYGGPIPEEAQPFFSPGFLWTRLPLGEEGDELIQSIVRPAFNDYLDLYLELAASAERVTDERSEVLLQGQRKYTDYRAEKDPARGMLTRFHGSEWTEAYIHTVLFDL

SEQ ID NO: 30233 - protein, 567 aa, Triticum aestivum
  misc_feature (139)..(139): Xaa can be any naturally occurring amino acid
  misc_feature (152)..(152): Xaa can be any naturally occurring amino acid
  misc_feature (166)..(166): Xaa can be any naturally occurring amino acid
  misc_feature (181)..(181): Xaa can be any naturally occurring amino acid
  misc_feature (221)..(221): Xaa can be any naturally occurring amino acid
  misc_feature (230)..(230): Xaa can be any naturally occurring amino acid
  misc_feature (318)..(318): Xaa can be any naturally occurring amino acid
MASSASAASPLTCHHLGIRHRPHLPSFSLRRRSTSPLSSKPISLSLSHSHSHSLPKPLIPSTARHLLPPVAAAPASPPAPVSPPAKPALQGAAIKPLLASIATGVIIWFIPAPAGVARNAWQLLAVFLATIVGIITQPXLPLGAVALLGLGXAVLTRTLTFASGLXSRFGDPIPWLIALAXFFFARGLIKTGLGNGVAYQFVKAFGGFTLGLGYSLVFAEXAFLAPAIPXSVSARAGGIFLPLVKSLCEACGSRTDDGTERKLGAWLMLTCFQTSVISSAMFLTAMAANPLAANLTLSTIGQGIGWTLWAKAAIVPGXLLSLLIVPLVLYVIYPPEVKTSPDAPRLAKERLAKMGPMSTEEKIMAGTLLLTVGLWIFGGMLSVDAVSAAILGLSVLLITGVVTWKECLAESVAWDTLTWFAALIAMAGYLNKYGLISWFSETVVKRPFVGGLGLSWQLSFGVLVLMYFYSHYFFASGAAHIGAMFTAFLSVASALGTPPLFAAMVMSFLSNLMGGLTHYGIGSAPVFYGAGYVPLAEWWGYGFVISVVNIIIWLGAGGFWWKMIGLW

SEQ ID NO: 30234 - protein, 379 aa, Streptococcus mutans
MKNEMLALILAGGQGTRLGKLTQSIAKPAVQFGGRYRIIDFALSNCANSGINNVGIITQYQPLALNSHIGNGSSWGLDGINSGATILQPYSATEGNRWFQGTSHAIYQNIDYIDSINPEYVLILSGDHIYKMDYDDMLQTHKDNMASLTVAVIDVPLKEASRFGIMNTDSNDRIVEFEEKPEQPKSTKASMGIYIFNWDRLRTMLVDAEKNNIDMSDFGKNVIPAYLESGERVYTYNFNGYWKDVGTIESLWEANMEYIGEDNDLHSRDRSWKIYSKNLIAPPNFITEEAHVKDSLVVDGCFVSGKVEHSILSTNVQVKEGAQIKDSFIMSGAVIGEGAKITRAIVGEGAKIGEDVEIDGTEEVQVIGYNEVVGVPNED

SEQ ID NO: 30235 - protein, 539 aa, Coccidioides posadasii
MKALTATLLVGTALAAVPPQQPIQVPTEDSAWAKPLENLKDTFKTLGNDAKQAWNELASAFPDAINEYTLFSAPKKHTRRPDTHWDHIVRGSDVQSIWVEGADGQKRREVDGKLEKYDLRVKAVDPSKLGIDKVKQYSGYLDDKENDKHLFYWFFESRNDPKNDPVVLWLNGGPGCSSLTGLFLELGPASIDKNLKVVHNPYSWNSNASVIFLDQPVNVGFSYSGGSVSDTIAAGKDVYALLTLFFKQFPQYATQDFHIAGESYAGHYIPVFASEILSHKNRNINLQSVLIGNGLTDPLTQYPHYRPMACGEGGYPAVLDESTCRSMDNSLPRCLSMIESCYSSESAWLCVPASIYCNNAMIGPYQRTGQNPYDVRAKCEDGGSLCYSQLGYITEWLNQKSVMDALGVEVSSYDSCNMDINRNFLFHGDWMKPFHRVVPGLIDQIRVLIYAGDADFICNWLGNQAWTDALEWSGREKFAKAELKDLTIVDNENKGKNIGKVKSYGNFTFMRLFGGGHMVPLDQPEASLEFFNRWLGGEW

SEQ ID NO: 30236 - protein, 548 aa, Xanthomonas oryzae
MRSDATPRPPLSHSQESSMLDANLKTQLTAYLERVTRPIQINASIDESPGSREMLDLLEELVLLSDKISLDIHRDDDQRKPSFALTTPGQDIALRFAGLPMGHEFTSLVLALLQVGGHPSKAAAELIEQVQHLDGDYRFETYFSLSCQNCPDVVQALNLAAVLNPRIKHVAIDGAWFQDEVETRQIMSVPTVYLNGELFDQGRMTLEQIVAKLDTNASKRDAAKIAAKGAFDVLVVGGGPAGAAAAVYAARKGIRTGVAAERFGGQVLDTMSIENFISVPETEGPKMAAALEQHVRQYEVDIMNLQRAEQLIPAGADGLIEIKLANGASLKSKTVILSTGARWRQMNVPGEDQYKNKGVAYCPHCDGPLFKGKRVAVIGGGNSGVEAAIDLAGIVAHVTLVEFDDKLRADDVLQRKLRSLHNVRIITSAQTTEVLGDGQKVTGLVYKDRTGGAIQHFDLEGVFVQIGLLPNTEFLRGTVALSPRGEIIVDDRGQTDVPGVFAAGDATTVPYKQIVIAMGEGSKAALSAFDHLIRSSAPATADNVAQAA

SEQ ID NO: 30237 - protein, 547 aa, Haemophilus somnus
MSESFAQLFEESLKDLETRVGSIVNATVVAIEKGFVYVDAGLKSEARIPAEEFQNAQGELDVKVGDVVNVALDAVEDGFGETKLSREKAVRQESWIDLEKAYEEQATVIGLINGKVKGGFTVELNGVRAFLPGSLVDTRPTREADHLLGKEQEFKVIKLDQKRNNVVVSRRAVIESENSQEREEILANLAEGSEVKGTVKNLTDYGAFVDLGGVDGLLHITDMAWKRVKHPGEIVSVGDEITVKVLKFDKDKTRVSLGLKQLGQDPWVAIAENHPVNSKLTGKVTNLTDYGCFVEILEGVEGLVHVSEMDWTNKNIHPSKVVHLGDVVEVMVLEIDEERRRISLGLKQCKPNPWLQFAETHNKGDKVSGKIKSITDFGIFIGLEGGIDGLVHLSDISWNIPGEEAVRNYKKGDEVEAVVLQVDSAKERISLGIKQLEEDPFNNFIAVNKKGAVVSAKVVEVDAKGAKVELVSGVEGYIRTADLSNEVVVGDVVEAKYTGVDRKSRIVHLSVKAKDQAEEAAAVANVNKEEIVIPNAMAEAFKAAKGE

SEQ ID NO: 30238 - protein, 113 aa, Nostoc punctiforme
MAVYQVRFINPTLGLDRTIAVPDDQYILDIAEDAGIRLPSGCKQGECSVCIAKLISGEVNQSEQKFLRPSEIQAAYVVTCVTYPLSNCTLETHQEQVLYKSALYYKPESGKSD

SEQ ID NO: 30239 - protein, 379 aa, Hieracium piloselloides
MTFAFASFRMQNHKLTKMALVFLSFFFLVASSRAAISNRIGINYGRLGNNLPSPAKSIELLESMNAGRVKLYDADHEILHLLSGKDIEVAITVANDEISAIAANQHLADQWVYEHVLAHYPNTKIRFILVGNEVFSSTNNVQDMQIARDLVPAMRRIKNTIKAQGIRNIKVGTPLAMDMMETTFPPSNGSFKPDIRELMIPLLKYLNGTRSFVLVDVYPYFRVVRQVARNNSDTGIDLGFALLRTSNMTYTDPQSGLVYTDLLDQMLDSVVYAMAKLGYDDIMLALAETGWPHDGDVDEIGANRENAAEYNNNLIKKMAAVPSNGTPARPGQIVPTFIFSMYDENQKYGPATERHWGLMNPDGSAVYAVNITGKVNPSD

SEQ ID NO: 30240 - protein, 467 aa, Bacteroides thetaiotaomicron
MEKIGRTKIVDLLKREDIGAMVNVKGWVRTRRGSKQVNFIALNDGSTINNVQIVVDLANFDEEMLKLITTGACISVNGVMVESVGSGQKVEVQAKEIEVLGTCDNTYPLQKKGHSMEFLREIAHLRPRTNTFGAVFRIRHNMAIAIHKFFHEKGFFYFHTPIITGSDCEGAGQMFQVTTMNLYDLKKDERGSISYDDDFFGKQASLTVSGQLEGELAATALGAIYTFGPTFRAENSNTPRHLAEFWMIEPEVAFNDIADNMDLAEEFIKYCVKWALDNCADDVKFLNDMFDKGLIERLQGVLKDDFVRLPYTDGIKILEDAVAKGHKFEFPVYWGVDLASEHERYLVEEHFKRPVILTDYPKEIKAFYMKQNEDGKTVRAMDVLFPKIGEIIGGSEREADYNKLMTRIEEMHIPMKDMWWYLDTRKFGTCPHSGFGLGFERLLLFVTGMSNIRDVIPFPRTPRNADF

SEQ ID NO: 30241 - protein, 193 aa, Griffithsia japonica
LGMVVRKVKGPWRPEEDAILTQLVAKLGPRRWTVIASHIPGRTGKQARERWLNQLSPDLAKRPWTPEEDRVVMQAHARLGNRWSEIAKLLKGRTDNATKNRFNTTIRRQISELAAGNARADSVGGASSVVDSGAPTEMGVASAGEGGGGLVEASVMGLSCDGDDRRNAKRKRDGSHSSHEPMSQRTKTLTAST

SEQ ID NO: 30242 - protein, 215 aa, Griffithsia japonica
GSVPRPILPIWYMYIKMMGSKGLREATEQAILNANYMATRLKGSFNILFRGSQGRCAHEFILDLRPFKASCGISETDVAKRLQDYGFHAPTMSWPVAGTLMVEPTESESKAELDRFCDAMIMIREEIRAVEEGRMDKEDNPLKHAPHTAAIVTADEWTRGYSREAGAYPASWVQGSKFWPTTSRVDDVFGDRNLVCTCPPLSAYLDEDEPKANVA

SEQ ID NO: 30243 - protein, 418 aa, Unknown
  Frankia sp. CcI3
MSTPFWGPDFDQLSATDPQIAEVVLDELDRLRGGLQLIASENFTSPAVLAALGSTLSNKYAEGYPGRRYYGGCQVVDRAEEIGIARAKQLFGAEHANLQPHSGSSANFAVYAALLTPGDTVLAMSLPHGGHLTHGSKVSFSGKWFNVVAYGVREDTELIDYDQVRELARQHRPKMIICGATAYPRLIDFAAFRSIADEVGSWLMVDAAHFIGLVAGGAIPSPVPYADVVSFTTHKVLRGPRGGMILAREELASRIDKAVFPFSQGGPLMHAVAAKAVALREAASPAYAQYARQVVANAQRLADELAAEGIRPVAGGTDTHLALLDLRELGVSGKEAEARCDAAGITLNKNAIPYDPQPPAISSGIRVGTPAVTTQGMGEGEMKEIAGLIAHAVREPEAAADVAAAVSALVARHPAYPR

SEQ ID NO: 30244 - protein, 278 aa, Bacteroides thetaiotaomicron
MSRTNFDTLLEAGCHFGHLKRKWNPAMAPYIFMERNGIHIIDLHKTVAKVDEAAEALKQIAKSGKKVLFVATKKQAKQVVAEKAQSVNMPYVIERWPGGMLTNFPTIRKAVKKMATIDKLTNDGTYSNLSKREVLQISRQRAKLDKTLGSIADLTRLPSALFVIDVMKENIAVREANRLGIPVFGIVDTNSDPTNVDFVIPANDDATKSVEVILDACCAAMIEGLEERKAEKIDMEAAGEAPANKGKKKSVKARLDKSDEEAINAAKAAAFIKEDEEA

SEQ ID NO: 30245 - protein, 385 aa, Haloferax volcanii
MSEDFYDVLGVSRDASKDEIKNAYRKKAAKYHPDVSDEDDAEEKFKKVQKAKEVLTDDEKRQMYDQVGHERFQQSQKRGGGGGGRGQGNPFGGGGNPFGGMGGGGGGFEDIFNNLFNGGAGGQQRNRPQQGRDVAQRISIDLEDAYHGVERDVTIRRREVCPECDGEGHPEDADVNTCSECNGSGQQTTVQQTPFGRVQQTTTCRACGGEGETYSEDCSECRGSGRVRRTRDVTITIPAGFRDGQRLRYRGEGEPGENGGPNGDLFVEVNVRDHDEFDRDGDDLRYTHPISFPQAVFGATVEVPTLDGEEELKVPAGTQSGSTFTVSGAGMPHLDGRGNGDLHVEVHVVTPEDLNSEQREALKEFAEAGGEEVKEGLFQKLKNSL

SEQ ID NO: 30246 - protein, 374 aa, Zea mays
MEVGDARNGSAAAALTKGGADDAARKPLPPCCVKAKARVPETEANCHDTVVSGWFTEPRSRFGEAHSLKVEKILFQGKSPYQEILVFESSTYGNVLVLDGIVQLTDKDECAYQEMVTHLPLCSIPAPKNVLVVGGGDGGVLREIARHDSVETIDICEIDLLVIDVSKEFFPNLSIGFKDPRVRLHVGDAVDFLRNSPEGKYDAIIVDSSDPIGPAQALVEKPFIQTIARALKPGGVLCNLAESMWLHTHLIQDMLAICRQTFKGAVHYGWTSVPTYPSGVIGFLLCAKEGRAVNFLTPVNPIEKIEGTTKAGRELRFYNSEIHRAAFVLPTFVRRELEAYTTPSTSAENEKPKESVSEPQKIKILSNNAILTAS

SEQ ID NO: 30247 - protein, 162 aa, Unknown
  Nocardioides sp. JS614
MSILDAKIARLDGTPSTLGEITGGRPALLVNVASKCGLTPQYAGLEELHERLADRGFTVVGLPCNQFRGQEPGTADEIAEFCSATYGVTFPMTEKIDVNGPDRHEIYRTLVDTPNESGESGDITWNFEKFLVDASGAVLARFSPGVEPGDPRLVAAVESQVG

SEQ ID NO: 30248 - protein, 401 aa, Nicotiana tabacum
MESRVLTGATAIRGLPLLRKPVVKLTAASFPTVAKPIGAVSGGANLIWGRQLRPDILLEASPKRESMKPCFTAASSPAEGSDSAGDAKVGFFNKATLITGFFFFMWYFLNVIFNILNKKIYNYFPYPYFVSVIHLAVGVVYCLISWTVGLPKRAPIDSTQLKLLTPVAFCHALGHVTSNVSFAAVAVSFTHTIKALEPFFNASASQFILGQQIPLALWLSLAPVVLGVSMASLTELSFNWLGFISAMISNISFTYRSIYSKKAMTDMDSTNVYAYISIIALIVCIPPAIIIEGPQLLQHGFADAIAKVGLTKFVTDLFWVGMFYHLYNQVATNTLERVAPLTHAVGNVLKRVFVIGFSIIVFGNKISTQTGIGTCIAIAGVALYSFIKAKMEEEKRQKKAA

SEQ ID NO: 30249 - protein, 458 aa, Listeria monocytogenes
MAQTSTIQNDTKAAEEYAARVFETIKQRNPGETEFHQAVEEFLNSVIPALAKEPKYEANGILEQLTEPERLISFRVPWVDDSGTVHVNRGYRVQFNSAIGPYKGGLRFHPSVTGSIVKFLGFEQIFKNSLTGLPIGGGKGGSDFDPKGKSDSEVMRFCQSFMTELQKHIGPDTDVPAGDIGVGGREIGYLFGQYKRLRGAYDAGTITGKGLSYGGSLARTEATGYGLVYFTVEMLEAAGETIRGKKIVVSGSGNVAIYAIEKAHELGAKVVACSDSAGFVYDKEGIKVETVKQLKEVERKRISEYTTIHPSAEYYAGGDVWSVPCDIALPCATQNEINADQARALVKNGVIAVAEGANMPSTLDAVDIYHENKVLFGPAKAANAGGVAVSALEMAQNSTRMSWTFQTVDEHLQNIMKDIYKNSSNAASEYGAPGNLVIGANIAGFLKVADTMISQGII

SEQ ID NO: 30250 - protein, 281 aa, Coccidioides posadasii
MAPKFLKALTAAAGLYASLAAAAPLQKRAIVWETVTDIVVETVEVTLTVTGVPGGPKTISPPELTTTTTEQPPPVPTTMYKAPPPPQSPPAPTTTAQAPPPPPPPPPPPPPPPAPTTTQAPQYPPPPPPPPPPAPTTSKAAPPPPPPPPPPPPPAPPAPKPSKPAPPPQPPTELPDPSKQVFSGDMTFYNGGLGACGTEIDTQGEDAVAISVDIMGSENNNSPYCGKTITIEYGGVTSKAVVKDKCPTCARGSLDMTRHLFYKFADEAEGRVHGVKWSFDD

SEQ ID NO: 30251 - protein, 112 aa, Thermosynechococcus elongatus
MKKVEAIIRPFKLDEVKIALVNAGIVGMTVSEVRGFGRQKGQTERYRGSEYTVEFLQKLKVEIVVEDNQVDMVVAKIIEAARTGEIGDGKIFVTPVEQVIRIRTSEKDHEAV

SEQ ID NO: 30252 - protein, 462 aa, Nocardia farcinica
MRIADHVVDLIGNTPLVRLNNVVGPNAGLVAAKIEYLNPGGSSKDRIAVKMIDAAEKSGQLKPGGTIVEPTSGNTGVGLALVAQQRGYKCVFVCPDKVSEDKRNVLRAYGAEVVVCPTAVPPDHPDSYYSVSDRLVREIDGAWKPDQYSNPGGPESHYETTGPEIWRDTDGRVTHFVAGVGTGGTITGAGRYLKEVSGGKVRVIGADPEGSVYSGGSGRPYLVEGVGEDFWPSAYDPAVPDEIIAVSDADSFEMTRRLAREEGLLVGGSCGMAVVAAIEVARRDPDAVVVVLLPDGGRGYLSKIFNDQWMSSYGFLRTRLDGSPEPLVGDVLRGKSGELPDLVHTHPSETLRDAIEILREYGVSQMPVVGAEPPVMAGEVQGSVTERDLLSAVFEGRAHLTDSVAQHMSPSFPLIGSGEPISAATKALSDTDALMVVEDGKPVGVITRHDLLGFLSTGSVGH

SEQ ID NO: 30253 - protein, 194 aa, Listeria monocytogenes
MRTATKTRVTAETSIELSINLDSQVESTISTGVGFLDHMLTLFAKHSRVTLNVKADGDTYVDAHHTVEDIGITLGLCLKEALADKASINRYGSAYVPMDESLGFCALDLSGRSYLVFDAELTNPKLGDFDTELVEEFFQAVAFNTEMNLHLRVLYGKNTHHKIEALFKAFGRALREAITINPEIKGVNSTKGVL

SEQ ID NO: 30254 - protein, 588 aa, Medicago truncatula
MNMVECKRKKESQGEKNNNMDSNSDFPDEVLERVLGMMKSRKDRSSVSLVCKEWYNAERWSRRNVFIGNCYAVSPEILTRRFPNIRSVTMKGKPRFSDFNLVPANWGADIHSWLVVFADKYPFLEELRLKRMAVSDESLEFLAFSFPNFKALSLLSCDGFSTDGLAAVATNCKNLTELDIQENGVDDKSGNWLSCFPESFTSLEILNFANLSNDVNFDALEKLVARCNSLKTLKVNKSVTLEQLQRLLVRAPQLCELGTGSFSQELTGQQYSELERAFNNCRSLHTLSGLWVASAQYHQVLYPVCTNLTFLNFSYAPLDSEGLSKLLVRCPNLRRLWVLDTVEDKGLEAVGSYCPLLEELRVFPGDPFEEGAAHGVTESGFIAVSEGCRKLHYVLYFCRQMTNAAVATVVENCPDFTHFRLCIMTPGQPDYQTGEPMDEAFGAVVKTCTKLQRLAVSGSLTDLTFEYIGKYAKNLETLSVAFAGSSDWAMQCVLVGCPKLRKLEIRDSPFGNAALLSGFDKYESMRSLWMSDCKVTMNGCRLLAQERPRLNVEVMQEEGGDDSQAGKLYVYRSVAGPRRDAPPFVLTL

SEQ ID NO: 30255 - protein, 501 aa, Novosphingobium aromaticivorans
MGASLNAMPRQKPRQDFRGLWNISFGYFGIQLAFALQNANVSRIFQSLGSAVDDLAFLWIAGPVTGLIVQPLIGYYSDRTWGRLGRRRPYFLAGAVLAGLALVGLPNTGLLLLAAAFLWMLDASLNVAMEPFRAFAGDMTPDDQRAQAFAFQTWFIGAGAVVGSLAPALFNWLGIANTAPEGIIPPSVRYSFYLGAAAMVLAVGWTVLRVREYSPDEMAAFEADATAPIAPEHEPLVYPRSGPAWVAVGAVLVAIVAALGLDRQLYVLGTGLAVFGAIQIGVRATAARGALAHIVSDLAQMPAQMKQLALAQFFTWIGFFIVWIYTTPVVTEQAFGATDVSSAAYNEGADWVGVMFAFYNGIAAVSAFLLPVLARRIGNARTHAVGLLCGASGFLGLLLIRDPWWLLLPMVGMGIAWASVLSMPYVILTRVLPARKFGIYIGIFNFFIVIPQLVVATLMGGIMRSFFPGEPRWTMLVAALMMAAAAGAMMLVREHRRDSAA

SEQ ID NO: 30256 - protein, 73 aa, Lactobacillus johnsonii
MAKEDVIEVEGKVVDTLPNAMFKVELENGATILAHVSGKIRMHYIRILPGDRVTVELSPYDLTKGRITYRFIK

SEQ ID NO: 30257 - protein, 185 aa, Pseudomonas fluorescens
MSADLEHIRQIMREADCLYTEAEVEAAIARVGAQINEQLADSNPVVFCVMNGGLIFSGKLLTHLQFPLEASYLHATRYRNETSGGDLFWKAKPEVSFIDRDVLIIDDILDEGHTLGAIIDFCRHAGARKVHTAVLIDKDHDRKARPDLKADFVGLPCIDRYIFGYGMDYKGYWRNANGIFAVKGM

SEQ ID NO: 30258 - protein, 145 aa, Bacillus anthracis
MSMSLYYKKIREQLGHELIFIPSVAAVIKNEQGEILFQYPGGEYWSLPAGAIEPGETPEEAVVREVWEETGLKVQVKKQKGVFGGEEYRHTYPNGDQVEYIVVVFECEITSGKLKSIDGESLKLQYFSLSEKPPLALPYPDKIFL

SEQ ID NO: 30259 - protein, 78 aa, Triticum aestivum
  misc_feature (27)..(27): Xaa can be any naturally occurring amino acid
  misc_feature (37)..(37): Xaa can be any naturally occurring amino acid
MSRGLYKISEWYTFLLKLHRVHVVTHXGVWRVIHKGXDTPVAAELVPNGDVFVQSDGEHFGFLPTKFSVLPGAVDFFS

SEQ ID NO: 30260 - protein, 93 aa, Unknown
  Malus x domestica
KSVETYKIYIFKVLKQVHPDIGISSKAMGIMNSFINDIFEKLAQESSRLARYNKKPTITSREIQTSVRLVLPGELAKHAVSEGTKAVTKFTSS

SEQ ID NO: 30261 - protein, 160 aa, Bacillus cereus
MTVYDFSAKTITGEEKSLKDYKGKALLIVNVASKCGFTPQYKGLQEVYDKYKDQGLEILGFPCNQFGGQEPGTEADITSFCELNYGVNFPMFAKVDVKGDKAHPLYTYMTEQAPGLLGMKAVKWNFTKFLIGKDGKVVGRFAPQTKPVDLEVEIEKVLGE

SEQ ID NO: 30262 - protein, 358 aa, Xanthomonas campestris
MSQSKPLFPLNAWYAVAWDHEVKHALTPRKLCNLDVVLYRTTAGAVVALEDACWHRLVPLSMGKLRGDDVVCGYHGLVYNAQGRCVHMPSQETINPSACVRGFPVAEKHRYVWVWPGDPAQADVALIPDLHWSHDPAWAGDGRTIHAKCDYRLVLDNLMDLTHETFVHGSSIGQDEVAEAPFEVVHGDRTVTVSRWMHNIDPPPFWAGQIARHLNYHGKVDRWQIIHFEAPGTIAIDVGVAITGTGAPQGDRSQGVNGFVLNTITPETDTTCHYFWAFMRNYALHDQSLTTLTREGVTGVFGEDEAVLEAQQRAIEAHPDHAFYNLNVDAGGMWARRVIDRLIAREQRAGDLSLRMVG

SEQ ID NO: 30263 - protein, 1064 aa, Glycine max
  misc_feature (205)..(205): Xaa can be any naturally occurring amino acid
MERARRLANRAILRRLVSEAKQHQKNESVLHSSTTPMLLYSSSRCMSSVSSPVLRSRGSKTETLLGRNINMSRGVVVAAAGGFLGVGSARSISVEALRPSDTFPRRHNSATPEEQSKMAESCGFGSLDSLVDATVPKSIRLKDMKFGKFDAGLTENQMIEHMKDLASKNKVFKSYIGMGYYNTHVPPVILRNIMENPAWYTQYTXPYQAEISQGRLESLLNYQTMITDLTGLPMSNASLLDEGTAAAEAMSMCNNIQKGKKKTFIIASNCHPQTIDICKTRADGFDLKVVTADLKDIDYKSGDVCGVLVQYPGTEGEVLDYGEFVKKAHAHEVKVVMASDLLALTVLKPPGEFGADIVVGSAQRFGVPMGYGGPHAAFLATSQEYKRMMPGRIIGVSVDSSGKTALRMAMQTREQHIRRDKATSNICTAQALLANMAAMYAVYHGPEGLKNIAHRVHGLAGAFALGIKKLGTVEIQDLPFFDTVKVKTSNAHAIADAALKSGINLRVVDGNTITVAFDETTTLEDVDNLFKVFAGGKPVSFTAASLAPEVQSAIPSGLVRKSPYLTHPIFNTYQTEHELLRYLYRLQSKDLSLCHSMIPLGSCTMKLNATTEMMPVTWPSFSDIHPFAPVDQAQGYQEMFNNLGELLCTITGFDSFSLQPNAGAAGEYAGLMVIRAYHLARGDHHRNVCIIPVSAHGTNPASAAMCGMKIVSVGTDAKGNINIEELRKAAETHKDNLSALMVTYPSTHGVYEEGIDEICNIIHDNGGQVYMDGANMNAQVGLTSPGWIGADVCHLNLHKTFCIPHGGGGPGMGPIGVKKHLAPFLPSHPVIETGGIPAPDKPQPLGTIAAAPWGSALILPISYTYIAMMGSKGLTDASKIAILNANYMAKRLENYYPVLFRGVNGTVAHEFIIDLRGFKNTAGIEPEDVAKRLMDYGFHAPTMSWPVPGTLMIEPTESESKAELDRFCDALISIRQEIAEIEKGKVDINNNVLKGAPHPPSLLMADAWTKPYSREYAAFPAPWLRTAKFWPTTGRVDNVYGDRNLICTLLPASQAVEEQAAATA

SEQ ID NO: 30264 - protein, 262 aa, Oryza sativa
VLTWNDGFYNGEIKTRKIENNLVTELTAEQLLLQRSEQLRELYNSLLSGESADQQRRRPVTALSPEDLGNVEWYYVVCMTYAFRPGQCVPGKSFASNGCAWLCNAQSADSKAFPRKLLAKNASIQTIVCVPFMTGVLELGTTDPAAVARGEAAAAGRMSPILRQIWREGRDSEDSVYELINHVFPSLHDKNNANFASYMSTHAILSTKNDYVDKLNANMIDRFSRHAKVYHSFDSVDDDPHNSYHLDFLNSITLQMVSHHTS

SEQ ID NO: 30265 - protein, 576 aa, Unknown
  Photobacterium sp. SKA34
MIDPEKHIALLKLKLNREHASRLAAEKLLEAKSHELYNANQLLNDSYEKLQMQAKFDSELLTYQNKMENLLLRYARLFLKHSATRESIQQLLDSLVDGIYISGCHISIYPADNINISGSYSSGRLQQWIPPADLDSTNSLWDIGEHTLWINIINNRGKIGVLAVRIACKDDRLPAIQKHMALFCELFRSAIGRQITFNQAIDAKKRAEDSEQSTRDFLAMINHELRTPLNGLLGSAELLQDTPLDNDQQKLLTTLNHSGELLRAIINDLLDYSKINAGMLELIEKPFDCHLLAVKLEDIFTHRSHEKRLDFNIYYSHDLPKVFIGDEDRIKQIFVNLISNAIKFTPAGFVHAKLWWHNKQLQFTVKDSGCGIDHSDQHKLFKPFSQVDITSKRSHEGTGLGLVICKQLCEQMGGSIRVESSLGRGACFNVSLPLPISDHTHFNATVRQPDKTPIKHLKVLVVEDLKTNQMIIKLMLNKVQIEPTIVDNGQKALDLLNVESFDVVFMDCRMPIMDGYTATKELRKKDYSKPIIALTAGTTSAEREACIQAGMNDILCKPYLASELHDILTIWGSAIE

SEQ ID NO: 30266 - protein, 828 aa, Salmonella enterica
MKLSRRSFMKANAVAAAAAAAGLSVPGVARAVVGQQEAIKWDKAPCRFCGTGCGVLVGTQQGRVVACQGDPDAPVNRGLNCIKGYFLPKIMYGKDRLTQPMLRMKDGSYHKDGEFTPVSWEQAFDVMEEKFKTALKEKGPEAIGMFGSGQWTIWEGYAAAKLFKAGFRSNNIDPNARHCMASAVVGFMRTFGMDEPMGCYDDIEQADAFVLWGSNMAEMHPILWSRITNRRLSDPNVKVAVLSTFQHRSFELADNGIVFTPQSDLVILNYIANYIIQNNAVNQDFFTKHVNLRKGATDIGYGLRPTHPLEKAAKNPGSDASEPMSFDEYKAFVAEYTLDKTAEMTGVPKDQLEQLAQLYADPNKRVISYWTMGFNQHTRGVWANNLVYNLHLLTGKISQPGCGPFSLTGQPSACGTAREVGTFSHRLPADMVVTNEKHRDICEKHWQIPAGTIPAKVGLHAVAQDRALKDGKLNVYWVMCNNNMQAGPNINEDRMPGWRDPRNFIIVSDPYPTVSALSADLILPTAMWVEKEGAYGNAERRTQFWRQQIKAPGEAKSDLWQLVQFSRRFKTEEVWPEALLAQKPELRGKTLYDVLFATPAVSKFPLSELKEDQLNDESRELGFYLQKGLFEEYAWFGRGHGHDLAPFDDYHNARGLRWPVVEGKETQWRYSEGNDPYVKAGEGYKFYGKPDGKAVIFALPFEPAAESPDNEYDLWLSTGRVLEHWHTGSMTRRVPELHRAFPEAVVFIHPLDAKARDLRRGDKVKVSSRRGEVISIVETRGRNRPPQGLVYMPFFDAAQLVNNLTLDATDPLSKETDFKKCAVKLAKV

SEQ ID NO: 30267 - protein, 484 aa, Bifidobacterium longum
MAEATANIGVIGLATMGSNLARNLAHHGNTVALFNRHYSRTEKLMNEHGTEGNFVPAETLEEFAASLKRPRTAIIMVKAGAPTDATIAQLEEVFEPGDIIVDGGNSFFKDTIKREKEVRAKGFHFVGCGVSGGEEGALNGPSLMPGGTAESWKTLGPILQSIAAKVNGEPCVTHIGTDGAGHFVKMVHNGIEYADMQVIGEAYDILRRGLGMDAEEIGDVFAEWNKGDLDSYLIEITAEILHHKDAETGKPFVDVVVDHAGMKGTGTWTVQTGLECGSPVAAIGEAVFARALSSHGELREDAQKEGLAGPNKTIDLAGEDKAAFVEDVRKALFASKVVAYAQGLNEIQDGAKEYGWDINLSEVARIWRGGCIIRAQFLLDRITEAFRGDNPPASLLFDPYFEKIIGESQDAWRRVIVRAVEAGIPTPVFSSSLAYYDGLRSKRLPTALTQSQRDFFGAHTYGRVDKPGVFHTLWAEEGKPEIEA

SEQ ID NO: 30268 - protein, 350 aa, Brassica napus
MKMSGVRMLASSPMLLFLLSLLMASYFDTTAGQIGVCFGQMGNNIPNPAEVVAMFKQYSIPRMRMYGPNPNALNALRGSNIEFILDVPNGDLKRLADSQAEANTWVRDNVQKYNDVRFKYISVGNEVKPGEPGAAALFQAMQNIDRALSAARLSDIKVSTTTFMRAFADTYPPSRGRFKDEYKNFLQPVIGFLVNKRSPLLVNIYTYFGYMNRDVSLEFALFQPNSNNEFTDPNNQLRYQNFFDANLDSVYAALEKSGGGSLDVVVSESGWPTQGGPGASVPNAEAYVNNLRLHVNKNGSPKRSGKPIETYIFAMFDENGKQTSPNDEYEKYWGMFSPTTRQLKYGVKFN

SEQ ID NO: 30269 - protein, 639 aa, Lactuca sativa
MMMDSCDCFETQWPADELLVKYQYISDFFIAFAYFSIPLELIYFVQKSAFFPYRWVLMQFGAFIVLCGATHFINLWTFSSHSKTVAIVMTIAKLSTAFVSCVTALMLVHIIPDLLSVKTRELFLKQRAEDLDREMGLIIKQEETGRHVRMLTHEIRSTLDRHTILKTTLIELGRTLDLEECVLWMPSRKGMILQLSHSLHNLIPFASTVPINLPIITEVFNSAEAIRIPHNCPLARIRTPVGSYIPPEVVAVRVPLLHLSNFEIDNWPDHSAKSYAVMVLILPLNGVRKWRDHELELVTVVADQVAVALSHASILEESMRARDQLMDQNFALNVARQEAEMAIHARNDFLAVMNHEMRTPMHAIIALSSLLLETELTPDQRAMIETILKSSNLLATLVNDVLDLSRLEDGSLELESEVFNLHGLLREVVRLINPIASVKNTSMTLNCDVDLPNFGVGDEKRLMQIILNVVGNAVKFTKGGHVSIQASVLNPEYLQEWQTPEFCPTFTQGLFYLLVQVKDSGSGIKQQDIPHIFTKFSEPRSASNRSGDGAGLGLAICKRFVDMMGGHIWIESGGLGKGTTVAFLVKVGECNYQNDLSIVRPKARTRPHQGSGELIKHRGDESYRGGGTASFPAHDHNSF

SEQ ID NO: 30270 - protein, 366 aa, Arabidopsis thaliana
MALSAIGFEGYEKRLEVTFFEPSIFQDSKGLGLRALTKSQLDEILTPAACTIVSSLSNDQLDSYVLSESSFFVYPYKVIIKTCGTTKLLLSIPPLLKLAGELSLSVKSVKYTRGSFLCPGGQPFPHRSFSEEVSVLDGHFTQLGLNSVATLMGNDDETKKWHVYAASAQDSSNCNNNVYTLEMCMTGLDREKAAVFYKDEADKTGSMTDNSGIRKNLPKSEICDFEFEPCGYSMNSIEGDAISTNHVTPEDGFSYASFEAVGYDFNTLDLSQLVTRVLSCFEPKQFSVAVHSSVGANSYKPEITVDLEDYGCRERTFESLGEESGTVMYQTFEKLGKYCGSPRSTLKCEWSSNNSCSSEDEKDEGI

SEQ ID NO: 30271 - protein, 430 aa, Leifsonia xyli
MTDTLPSTFTASLAEVDPEIAEVLQLELGRQRDYLEMIASENFVPRAVLESVGSVLTNKYAEGYPGRRYYGGCEYVDIAEQLAIDRAKSLFGAEYANVQPHSGASANAAVLSAIATPGETILGLELAHGGHLTHGMKLNFSGKLYNAVAYGVDPETFLVDMDAVRDRALEHKPQVIIAGWSAYPRQLDFAAFRAIADEVGAKLWVDMAHFAGLVAAGLHPSPVPYADVVSSTVHKTLGGPRSGFIVSRDTELAKKLNSNVFPGQQGGPLMHVIAAKATAFKLAATDEFKDRQARTIRGAQLLAERLTAADSRASGVDVLTGGTDVHLVLADLRTSELDGQQAEDILHEVGITVNRNAVPFDPRPPMVTSGLRIGTPALATRGFGDTEFTEVADIIALALRPGADTRALRARVDALTAAFPLYPGLAPSAS

SEQ ID NO: 30272 - protein, 737 aa, Lactuca sativa
MDSCNCIEPQWPADELLMKYQYISDFFIALAYFSIPLELIYFVKKSAVFPYRWVLVQFGAFIVLCGATHLINLWTFNAHTRTVAIVMTTAKVLTAAVSCATALMLVHIIPDLLSVKTRELFLKNKAAQLDREMGIIRTQEETGRHVRMLTHEIRSTLNRHTILKTTLVELGRTLGLEECALWMPTRSGLELQLSYTLRHQNPVGFTVPIQSPAINQVFSTNRAVKISPTSPVARLRPASGKYMLGEVVAVRVPLLHLNNFQIYDWPELSTKRYALMVLMLPSDSARQWHVHELELVEVVADQVAVALSHAAILEESMRARDLLMEQNVALDLARREAETAVRARNDFLAVMNHEMRTPMHAIIALSSLLQETDLTPEQRLMVETILKSSNLLATLINDVLDLSRLEDGSLELDTTTFNLHALFKEVLNLIRPVASVKRLFVTLSLSSDLPEYAVGDEKRLMQIILNIIGNAVKFSKEGSISISAIMAKPDSLRDPRAPDFFPLLSDNNFFLRVQVKDTGMGISQQDMPKLFTKFAESQSPATRNPGGSGLGLAICKRFVNLMEGNIWIESEGLGKGSTAIFFVKLGFPSRLNGSRLPHMRVPAKLGQTKFPGLKVVVVDDNGVSRTATKGLLVHLGCDVTTVSSGEECLQAITKDSYKVVFIDVSLSSDAYNVARLVHEKLPKRHEKPPPLIVGLTGNTDKAMKESLLRAGMDGLVLKPVSVEKMRLALSELLEHNT

SEQ ID NO: 30273 - protein, 548 aa, Magnetospirillum magnetotacticum
MEMVHPVGLPAWKDLAALAATTGQKPMRDMFAADPGRFGRFSARLGDLLLDYSKNRIDAEVMAALIRLARQAGLAEARDAMFGGETFNITERRAVLHTALRNRSERPVMVDGQDVMPEIRAVLARMKTFAEQVRSGEWKGATGRAIQSVVNIGIGGSDLGPVMVTEALKPYQRDDLAVRFISNVDGSHAAEVLKLCDPETTLFIVASKTFTTQETIANAKTCRAWTVDKLGEAAIPNHFVALSTNARAVADFGIDTANMFEFWDWVGGRYSLWSAIGLSIAVAVGFGRFEELLAGGHAMDEHFRESPLEANLPVILALIGIWNANFLGADAYAVLPYDQYLHRLPAYLQQLDMESNGKGTARDGAMVGWGTGPMVFGEPGTNGQHAFYQLIHQGTRLIPCDFLAAAQTHNPLGEHHLMLLSNVFAQAEALMRGKTEAEARAELEKAGMSTAEIAFQLPHRVFPGNRPSNTLLYPRLDPFMLGQLIALYEHKVFVQGVIWDVNSFDQWGVELGKVLAKAILPELSSSAPVTNHDSSTTGLIEAVRALRR

SEQ ID NO: 30274 - protein, 322 aa, Unknown
  Shewanella sp. MR-4
MSKIFEDNSYTIGNTPLVRLNRVSQGKVLAKVEARNPSFSVKCRIGANMIWDAEKKGLLTKDHELIEPTSGNTGIALAYVAAARGYKLTLTMPNTMSLERRKLLKALGANLVLTEGAKGMKGAIDKAEEIRQSAPEKYIMLQQFNNPANPEIHEKTTGPEIWNDTDGAVDVFVAGVGTGGTITGVSRYLKKVAGKAITSVAVEPADSPVITQTLAGLPVQPGPHKIQGIGAGFIPGNLDLELIDRVETVTNDEAIDMARRLMQEEGILVGISSGAAVVAANRIAALPEFADKNIVVILPSAAERYLSSVLFQGQFGDEENIQ

SEQ ID NO: 30275 - protein, 382 aa, Pseudomonas syringae
MSAPVVIIGTGLAGYNLAREFRKLDADTPLLLITADDGRSYSKPMLSTGFGKNKEADGLSMAEPGAMADQLKAEVRTHTRISGIDPGHKRLWIGEEAVHYRDLVLAWGAETIRVPVEGDAGDAIFPINDLQDYARFRAAAAGKRRVLILGAGLIGCEFANDLILGGYEVDLVAPCEQVMPTLLPPAAAAAVKTGLESLGARFHLGPVLTRLNRSGDGLQAHLSDGQVMDCDLVVSAIGLRPRIDLAAAAGLQTGRGILVDRQLQTSHANIHALGDCAEVDGLNLLYVMPLMSCARALAQTLAGTPTAVKYGPMPITVKTPACPLVVSPSPRGTDGRWSVEGQGADIKALCHDADGNLLGYALTGAAVVEKLALNKVLPALLA

SEQ ID NO: 30276 - protein, 758 aa, Lactuca sativa
MSKTLASLGLISLLLVGVLAVDDDGSENGFGGCNCEVEGFFGYRNIMETQRVSDFLIAVAYFSIPIELLYFVSCSNVPFKWVLFQFIAFIVLCGMTHLLNGWTYEPHPFQLMLALTIFKFLTALVSFATAITLVTLIPLLLKVKVREFMLRKKTWDLGVEMGMIKKQKEAGWHVRMLTQEIRKSLDRHTILYTTLDKLSEILDLQNCAIWMPDNTKTVMNLTHQLKGGQSSTIIPIQNPEVQEIKQSEVVKLLDHESELGTLSSGGSEPPGAVAAIRMPMLRVSDFKGGTPEMIQACYAILVLVLPGGQIRSWTGPELEIVKVVADQVAVALSHAAVLEESQLMRDKLAEQNRALQQAKHDAMRASQARNLFQTVMSKSLRKPMHSIVGLLSLIQDDNLMNQQKVLIDSMVKTSNVLSMLIDDVMDDSSKERFPLEMRSFRLHSLIKEAAHLAKCLCVYKGYEFVMDVDKSLPDNVMGDERRVFQVILHMVGYLLNRGNGGGGMVLRILKESGSYGRNDQRWASWRSNSGDGYVSVKFEIGINDHDTKLERSFADERIRSGGVEQSLSFGMCRKLVEMMQGKIWVVPNPVGFDQAMSLILRFQLRPSIVIGISEAGESSDHNPLSNSIFRNLQVLLADEDDMNRAVTRKQLEKLGCIVSTVASGSDCIMALNQPVSSYQIILLDLHMSDVDGFEVAARIRKSRSRNWPLIVALTASGDADVWERCLQMGINGVIQKPVVLQGISDELRRVMVHTNKVH

SEQ ID NO: 30277 - protein, 468 aa, Magnaporthe grisea
MLEKSLLDSDPEVAEIMKHEIQRQRESIILIASENVTSRAVFDALGSPMSNKYSEGYPGKRYYGGNQHIDEIELLCQRRALAAFNVTEDKWGVNVQCLSGSPANLQVYQAIMPPHGRLMGLDLPHGGHLSHGYQTPQRKISAVSTYFETMPYRVDLETGIIDYDQLEKNVVLYRPKILVAGTSAYCRLIDYARMRKIADLVGAYLVVDIAHISGLVASGVIPSPFLHADVVTTTTHKSLRGPRGAMIFFRRGVRSVDPKTGKETMYDLEEPINFSVFPGHQGGPHNHTITALAVALKQASTPEFKAYQQQVVDNAKALENSFKELGHKLVSDGTDSHMVLVDLRAHSLDGARVEAVLEQINIACNKNSIPGDKSALTPCGIRIGTPAMTSRGFGVEHFQRVAKYIDESIKICKDVQAALPKEANKLKDFKAKVASGEVSRINELKKEIASWCQTFPLPVEGWRTDAGI

SEQ ID NO: 30278 - protein, 276 aa, Hevea brasiliensis
DKIVVDKPIYVKALMSKTAGSIVGAALRRDPHEAEFIQSVQEAVHGLERVIAKNTHYVNIMERLLEPERMLLFRVPWVDDRGETHVNRGFRVHFNQALGPCRGGIRFHPSMNLSIAKFLGFEQTLKNALSPYKLGGAAGGSDFDPKGKSDNEIMRFCQSFMNEIYRYLGPDKDLPAEEMGVGTREMGYLFGQYRRLVGHFQGSFTGPRIFWSGSSLRTEATGYGLVFFAQLMLADMNKELKGLRCVVSGSGKIAMHVLEKLIAYGAVPVTVSDSKG

SEQ ID NO: 30279 - protein, 763 aa, Lactuca sativa
MSKSLVIGFLIASLILTVSLANENEFAHCHCDDEGSWNAHIIESQRVSDFLIAIAYFSIPLELLYFLSCSNVPFKWVLVQFIAFIVLCGLTHLINGWGYYGNQTFQLMMALTVAKLLTALVSCATAITLLTLIPLLLKFKVRELFLKQNVLELDQEVGIMKKQKEAGWHVRMLTHEIRKSLDRHTILYTTLVELSNTLVLQNCAVWMLNDAKTEMNLTHELRPNSSGYHSSIPKNDPDVLEITGKKGVTMLRVDSELAVKSRGGIAESGPVAAIRMPMLHVSNFKGGTPELVDTCYAILVLVLPDSDRKWSFDEMAIVEVVADQVAVALSHAAVLEESQTMRDQLVEQNRVLQHAKENAMMASQARNSFQKVMSHGMRRPMHSIMGLLSILQDDQKNTNQTNIIDTISKTSSVLSTLINDVMEISAKDTGRLPLEIRPFQLHSMVKEACCLVKCLCIYQGFGFSMEVPSSIPNLVMGDEMRTFQVLLHMVGHLLDVSEEGRLVMFRVSLENGNEGRNDKVWGTGRSGSVDFVNVKFEIGTGDGGFQSELAIPSMHSGVKRQNAGGVKDSLSFSMCKKLVQMMQGKIWMSSNSKGNIQSTTLVLKFQIQHAFKRPPHFDLTNYVDQPKSNSIFRGLQVILADDDGVNRMVTKKLLEKLGCHVTTVSSGFECLSSLGPTTTPFHIVILDLHMPEMDGYEVATRIRKFRSRNRPLIVALTASAEEQVWERCLQVGMNGVIRKPVLLRGLENELRTVLQRAGERLSS

SEQ ID NO: 30280 - protein, 142 aa, Arabidopsis thaliana
MNGNNDYHQRIEIALPYITQVSQNLSTFIVSFFVPKAFQPDPPPGNNLHVQRWDSRYVAVKQISGYVADHKIGKQVAELKASLQGTVWAKAIEKSRETGGVGSAWAYTVAQFSWPFQWSQRVNEIWFPFEMEDEETVSIVTQ

SEQ ID NO: 30281 - protein, 128 aa, Oryza sativa
MATIAAAAAARTAVVGRPSGVAQLRARRGERVRCGYSSRDGKEATPAAAVKGATSMLAAAVTASSSSAPAAMALVDERMSTEGTGLSLGLSNNLLGWILLGVFGLIWSLYTVYTSTLDDDDESGGLSL

SEQ ID NO: 30282 - protein, 1566 aa, Ustilago maydis
MSAATPTSPGFPLTMGTGVMAAHFAAPSSNAGSPRSRPTTPLSAGLTPSGPTYDDLGRWDDADVASWLNAARLGHYASIFAEHDIRGSVILDVDQAALKEMGITMVKDRVRISAAIKLLNKRCADSAVARRPSVVSISPLLPLASHPLYAHEGEIEYLQHDHTADPSADGSGSNFGLNSMGMRRGQMRPPPLTLKQSTSRGMPGYASPAGSINQSQGFGLSAARGLTPGAARGSVWNTASSSSATSKPGTPDGALHRKVNSIGGVAAPLAVGASSSLSSSRHPYGHAVHSNRPSTATGASGYSNVPASQSLRSNHTSSSPTATSFGSNINAASARPSTATGAQSYTTNVPGTSSARDGYSPLTPISESNSLGNTPTTPSGIQQQQQSAGYAVGRGPFASSQRYAASSVPSQQQPSSGHTLRHVDSGEGYNLAGYQNPNPPTLEDLKRRTIKFISEEDNTTRIVNVSDCRDAYDVMARVLKKFGKPPSGNSYTPTADQGPTGDELGATETWGIFATSADGQNTKALSDNELLAICHAPQPHDPLRERGLTLRRIPNHLPGEDARKVPVRSGRNKLEAFFGERMPVAQMQPAGPGSGVNADEEDAGSVTISGKKMKRASTVSIMSGLGVGPFSSSSHNTGAGHTHGSTRAEGKLLSKKESKHMSPPPVTSKPSKIRNFFGQRPPSELINTNLADFFPSTDSKALQRTARRSIYGRASASTRSKRNSTWSFVADPDAPPLPNKGSMDGHPTPLERSSISIRERGTTPVIQIGYDSRSEDDHQSNARRTSSGTHSHLHPSLTGPPTLPPVVSRDSLDEWSRDLKAVGSPVTEENAMFQSSRHGHASGSQQHHAAMKHYPSHASGYADRPSISRRASGESARSRRSLASQVRHGLSAARERNADTASLLTVDEITQEVENRRESISLAGAGGGWVVDEDGVPIPIPGSSSPFSSSAAASTRPSSGISSSYVHNGHLEHDDSEGHSDEEANQSSDLEEATRTRKARGVPSKAASIRTVASKRASSVLQAPGDESDRHLGDPMAVARSTTSRASSVSELRRSVHDHGDPSDGESGSDFTDSDLDSDGSETDEDEQANDVYLPSAKPAPIKWHKGALIGAGSFGNVFLGMNAKTGLLMAVKQVELPSGDSHLDQRKKGMLEALEREIKLLKSLEHENIVQYLDSFADDSHLNIFLEYVPGGSIVALLRNYGAFEEPLVRNFVRQILNGLSFLHNRGIMHRDIKGANILVDNKGGIKISDFGISKKVESDLVLATNKGGAGGGGAGGAAHRPSLQGSVFWMAPEVVKQTSYTIKADIWSLGCLVVEMISGTHPWAELNQMQALFQIGMGRKPSLPDEISNECRDFLEKTFELDYNNRPSADELLNHAFMGTEMTFPPSSGADGSGGGDDDAGGSGDAGDGDASTMGMTNDAETGTTRETRETKDGKRPTRSKSTRRLEREKRHKEAAAAAAAATALDTGTPNTPTSHTAAAAAAAAAASASASASASPAVASTSPAPGDAETGSPTNGKSAVPPAGSTGGTPESILTVSIATARGNSTSTALSAADAAFSEEADS

SEQ ID NO: 30283 - protein, 354 aa, Unknown
  Sulfitobacter sp. EE-36
MSQFLPLLVTDIQRTIRDAVVLTLQPEDPKAFAFKQGQYLTFKQDFDGTELRRNYSICAGLDDGVLQVGIKRVDGGAFSTFANEVLKVGDTLHAMPPQGTFSAGLEPDRARNYLGFAGGSGITPVLSILKTVLKREPKSTFTLVYANRAVNTIMFREELEDLKNRYMGRLSVIHMLESGQDIDLFTGRVDQNKCAELFKTWIDVSDMDMAFICGPEPMMLAIADALKTHGLEPEQIKFELFSESQQGRLAKQEMAKRSEGQAQTQVTVKIDGAQHSFTMAKGQSVLDAALENNLDAPFACKAGVCSTCMCKVTEGEVEMLSNHALEDYEVERGYRLSCQSYPLSDTLFIDYDHH

SEQ ID NO: 30284 - protein, 161 aa, Unknown
  Shewanella sp. MR-4
MTSTIYSHSANDIQGNPTALAQYQGKVILIVNTASECGFTPQYKGLEALYQKYKAQGLVVLGFPCNQFGAQEKADEKGIQSFCELNFGVSFPLFSKIEVNGEHTHPLYQYLKKAAPGVLGTERIKWNFTKFLVNRQGEVVARFAPTTKPEAISDKIEALLK

SEQ ID NO: 30285 - protein, 221 aa, Xanthomonas oryzae
MRSCTMLGIGAFKQRIPRPGEALPGREQALPLHNTHLINGHPLRGEFTGLAQVQFGLGCFWGAERKFWKVPGVYTTAAGYAGGQTPNATYSEVCSGQTGHTEAVLVVFDEQAVSFEHLLRTFWESHDPTQGMQQGNDVGTQYRSAIYCTTQAQYAAALASRDAYQQQLTAAGYGAITTEIGFPAPTFYYAEDDHQQYLAKHPNGYCGLGGTGVSCPIGLDA

SEQ ID NO: 30286 - protein, 122 aa, Gloeobacter violaceus
MNKIEAIIQPSRLDAVEQALAAIGVQGMTVSRVEGFGRQRGHSVIFRGFGSAAQFLAKLKLEIVVPDEFTETVVERIVQAARTGSVGDGKIFVLPVTQAVRVRTGECDLEAVRFESPAVLIH

SEQ ID NO: 30287 - protein, 259 aa, Nostoc punctiforme
MNRTEKQENEYLGKVYLVGAGPGDPGLLTLKAKGLLECADVVIYDALVSPAILAMINPQAEQINAGKRRGKHSLFQEETTQLLIDKAQDRAIVVRLKGGDPFIFGRGGEEMEELVNAGISTEVVPGITSGIAAAAYAGIPLTHRLYSSSVTFVTGHEAAGKYKPKVNWNAIAHGSETIVIYMGIHNLPYIVEQLSAAGLDVETPIALVRWGTRPEQEELIGTLKTIVEQVEQTGFGAPAIAVIGQVVNMHSILSSCRPV

SEQ ID NO: 30288 - protein, 488 aa, Pseudomonas fluorescens
MIQTETDMQLIWLRSDLRQHDNTALAAAAERGPSVAVYLLSPQQWQEHDDAPCKIDFWLRNLHKLSKSLGDLNIPLLIRTAPHWDQAPAVLLELCRQLKIEAVHVNEEYGINESRRDAAVAKALQAEGITFHSYLDQLLFKPGSVLTRTGTYFQVFSQFRKVCYEHLHRSMPSLKQAPGKQSALNIASDPVPEAIEGFPTPGASLRALWPAGETEARRRLDTFADAQIDYYKSERDFPAKPGTSQLSAYLAAGVISPRQCLHAALQSNQGEFESGKVGAVTWINELLWREFYKHILVGYPRVSRHRAFRPETEDLAWRNAPEDLAAWQEARTGLPIIDAAMRQLLETGWMHNRLRMVVAMFLTKNLLIDWREGERFFMRHLIDGDLAANNGGWQWSASTGTDSAPYFRIFNPVSQSEKFDSEGLFIKHWLPELAGLNKKEIHNPASVGGLFGVADYPAPIVNLSASRERALAAFKNLPSRSSQGESDE

SEQ ID NO: 30289 - protein, 235 aa, Anthoceros formosae
MKQKYWNINLEEMMEAGIHFGHQAAKWNPKMKPYIFTERRGIHILNVTKTARLLSEACDFVANAASKGKQFLIVGTKYQAADLVASAALKARCHYVNQKWLGGMLTNWSTIEKRLRKFEDLQTKKNMGALDELPKKEAANLERQLAQLQKYLGGIRYMTNLPDIVIIVDQQKELTAIRECINLNIPTICLVDTDCDPDLTDISIPANDDARASIRWVLDKLTSAIQEGRCNSTKI

SEQ ID NO: 30290 - protein, 308 aa, Zea mays
MPGQWEFQVGPSVGISSGDQVWVARYILERITEIATAERLIREAHKKGAKIVLVQELFEGHYFCQAQRLDFFRRAKPYKGNPTIIRMQQLAKELEVVIPVSFFEEANNAHYNSVAIIDADGADLGLYRKSHIPDGPGYQEKFYFNPGDTGFKAFKTKYATIGVGICWDQWFPECARAMALLGAEILFYPTAIGSEPQDCNLDSREHWKRVMQGHAGANLVPLVASNRIGRETVDTEHGKSSITFYGNSFIAGPTGEIVKLANDKDEEVLVAEFDLDEIKSIRHGWGIFRDRRPELYKVLLTLDGEKQS

SEQ ID NO: 30291 - protein, 124 aa, Oryza sativa
MATVSAAAATSVVARAVLAGPLGLPQMRARRSERVRCNYSKEAATPAAAVKGAGASLLAMAATAAPAMALVDERMSTEGTGLSLGLSNNLLGWILLGVFGLIWSLYTIYTSDLEEDEESGGLSL

SEQ ID NO: 30292 - protein, 390 aa, Vibrio vulnificus
MFSINSIEVVMKKLSKLLISAAIALPLMFTLLAKVGVADTIDKTAPNLASLPVATLAGGCFWCTESDLEKLNGVYDVVSGYSGGEMANPTYRQVSSGKTGHIEVIQFRYDPNVVSYEAVLDYFLRHIDPTDDKGSFVDRGPQYRPAIFYHTAEQKQIAERFLKEVDEAKIYPKPIKTELIEYTAFYPAEQYHQDYYKKSSLKYKYYRHASGRDQYLDKVFGDDRIEQPKTLRQLIDEKALTKNAKTYSRPSDKEIKAQLTDLQYYVTQKEGTERPFNNEYWDNKEAGIYVDIVSGEPLFSSTDKYKSGTGWPSFTKPISSAYIVTKTDYKLLYPRTEVRSKFADSHLGHVFDDGPAPTGLRYCMNSAAMKFVPVAQMEKMGYGEYLTLFQ

SEQ ID NO: 30293 - protein, 151 aa, Vibrio fischeri
MNKTTRVMPAHKHIALVAHDNYKPELLRWVKENKDALQGHFLYATGTTGRILSKETGLAIKSLLSGPMGGDQQLGALISEGKIDMMIFFWDPLNAVPHDPDVKALLRIATVWNVPVAMNRASAKFMISAPQMEEEVSIEIPDYDAYLAERV

SEQ ID NO: 30294 - protein, 358 aa, Oryza sativa
  misc_feature (204)..(204): Xaa can be any naturally occurring amino acid
  misc_feature (316)..(316): Xaa can be any naturally occurring amino acid
MAAMATTASSLLKTSFAGARLPAAARNPTVSVAPRTGGAICNSISSSSSTPPYDLNAIRFSPIKESIVSREMTRRYMTDMITYADTDVVVVGAGSAGLSCAYELSKDPSVSVAVIEQSVSPGGGAWLGGQLFSAMVVRKPAHLFLDELGVAYDEQEDYVVIITHAALFTSTVMSRLLARPNVKLFNAVAVEDLIVKEGRVGGVXVTNWALVSMNHDTQSCMDPNVMESRVVVSSCGHDGPFGATGVKRLQDIGMIDAVPGMRALDMNTAEDEIVRLTREVVPGMIVTGMEVAEIDGAPRMGPTFGAMMISGQKAAXLALKALGRPNAIDGTIKKAAAAAAAHPELILASKDDGEIVDA

SEQ ID NO: 30295 - protein, 236 aa, Zea mays
MTVPDAESRFHVLAVDDSLVDRKLIEMLLKTSSYQVTTVDSGSKALELLGLRDASSPSPSSPDHQEIDVNLIITDYCMPGMTGYDLLKRVKGSSSLKDIPVVIMSSENVPARISRCLQDGAEEFFLKPVKLADMKKLKSHLLKRKQPKEAQAQQGQAVELEPEQQLDPRAQPAHDAEETAAEPPPAASNGTADGGNKRKAAAMEEEGMLAVMTVAAPESSTKPRLSTTSNSLAVET

SEQ ID NO: 30296 - protein, 449 aa, Geobacillus kaustophilus
MTHIRFDYSKALAFFGEHELTYLRDAVKVAHHSLHEKTGVGSDFLGWLDWPVDYDKEEFARIKEAAKKIQSDSDVLVVIGIGGSYLGARAAIEMLHHSFYNALPKEKRKTPQIIFVGNNISSTYMKDVIDFLEGKDFSINVISKSGTTTEPAIAFRIFRKLLEEKYGKEEARRRIYATTDSKRGALRTLANEEGYETFVIPDDIGGRYSVLTAVGLLPIAASGADINAMMEGAAKARDDFSSSELEENAAYQYAAIRNILYNKGKTIELLVNYEPALHYFAEWWKQLFGESEGKDQKGIYPASADFSTDLHSLGQYIQEGRRDLFETVLKLEEPRHELIIEAEENDLDGLNYLAGKTVDFVNTKAFEGTLLAHTDGGVPNLVITLPKLDEYTFGYLVYFFEKACAMSGYLLGVNPFDQPGVEAYKKNMFALLGKPGYEQLKEELEKRLK

SEQ ID NO: 30297 - protein, 104 aa, Vibrio vulnificus
MESSRDVRILKDLDDDIKGKDVLIVEDIIDTGNTLNKIKEILSLREPKSIEICTLLDKPSRREVPVPVKWIGFEIPDEFVVGVGIDYAQKYRHLPFIGKVVPQE

SEQ ID NO: 30298 - protein, 252 aa, Arabidopsis thaliana
SSTISLQSISMTTLNNLSYSKQFHRSSLLGFSKSFQNFGISSNGPGSSSPTSFTPKKKLTPTRALSQNLGNTENPRPSKVQELSVYEINDLDRHSPKILKNAFSFRFGLGDLVPFTNKLYTGDLKKRVGITAGLCVVIEHVPEKNGDRFEATYSFYFGDYGHLSVQGPYLTYEDSFLAITGGAGIFEGAYGQVKLQQLVYPTKLFYTFYLKGLANDLPLELIGTPVPPSKDVEPAPEAKALKPSGVVSNFTN

SEQ ID NO: 30299 - protein, 467 aa, Saccharomyces cerevisiae
MPPKEDWEKYKAPLEDDDKKPDDDKIVPLTEGDIQVLKSYGAAPYAAKLKQTENDLKDIEARIKEKAGVKESDTGLAPSHLWDIMGDRQRLGEEHPLQVARCTKIIKGNGESDETTTDNNNSGNSNSNSNQQSTDADEDDEDAKYVINLKQIAKFVVGLGERVSPTDIEEGMRVGVDRSKYNIELPLPPRIDPSVTMMTVEEKPDVTYSDVGGCKDQIEKLREVVELPLLSPERFATLGIDPPKGILLYGPPGTGKTLCARAVANRTDATFIRVIGSELVQKYVGEGARMVRELFEMARTKKACIIFFDEIDAVGGARFDDGAGGDNEVQRTMLELITQLDGFDPRGNIKVMFATNRPNTLDPALLRPGRIDRKVEFSLPDLEGRANIFRIHSKSMSVERGIRWELISRLCPNSTGAELRSVCTEAGMFAIRARRKVATEKDFLKAVDKVISGYKKFSSTSRYMQYN

SEQ ID NO: 30300 - protein, 322 aa, Arabidopsis thaliana
MASRIAKDVTELIGNTPLVYLNNVAEGCVGRVAAKLEMMEPCSSVKDRIGFSMISDAEKKGLIKPGESVLIEPTSGNTGVGLAFTAAAKGYKLIITMPASMSTERRIILLAFGVELVLTDPAKGMKGAIAKAEEILAKTPNGYMLQQFENPANPKIHYETTGPEIWKGTGGKIDGFVSGIGTGGTITGAGKYLKEQNANVKLYGVEPVESAILSGGKPGPHKIQGIGAGFIPSVLNVDLIDEVVQVSSDESIDMARQLALKEGLLVGISSGAEAAAAIKLAQRPENAGKLFVAIFPSFGERYLSTVLFDATRKEAEAMTFEA

SEQ ID NO: 30301 - protein, 542 aa, Saccharophagus degradans
MKTKNAKKTNKQPLTPKQKQISVLLERAMKHHNQGQLTQAENLYNAILEIDENNVDANHLLGVKHIQTRHFEKALHYLKKAIAIQPNNALPHYNLGLAYQHMYACDKAASSYENAIRCKPDHIESILNAGSMYMYLQDRYNAEKKFRRAVHLAPNRLDANNNLGLCLFEQHQNKDARTYFIKAIEIAPNNPEGHNNLASLEQSEGNILEAMEAYKKAITLNPSYYTAINNLAFTHERHLELDKAKKLYEEASTSPEHAVISNTTLATYCWIDNDIAACEKYLETTIDYSTKPYSPKQNKFIVGYSQFLLALIENYKLAPIPYLETDAALAPISIAGDSHSLTYANLTIQIENELYRGAPKLMTGCKAWHLANEAENEYKFQFKKLITKQAENSTLLVSLGEIDCRSDEGILVAFKKSAKNKNLSINFKDSKTLAALTNQIRDLTEQYCKYVSEACATKNIQAYLFNVPAPLKANLDEQALYELQVLIASYNQSLSESATGFKNISIIDLYSVTNDLNGFSSGKYHIDQVHLSPAICGKIFGR

SEQ ID NO: 30302 - protein, 474 aa, Bacillus cereus
MNGYVYLVGAGPGDEGLITKKAIECLKRADIVLYDRLLNPFFLSYTKQTCELMYCGKMPKNHIMRQEIINAHLLQFAKEGKIVVRLKGGDPSIFGRVGEEAETLAAANIPYEIVPGITSSIAASSYAGIPLTHRDYSNSVTLLTGHAKGPLTDHGKYNSSHNSDTIAYYMGIKNLPTICENLLQAGKKEDTPVAVIEWGTTGKQRVVTGTLSTIVSIVKNENISNPSMTIVGDVVTLRNQISWKERKPLHGKKVLFAAATNKKSAIKQKLQESGAEIYQIPTFKKKEYTVTSEQINKIFNVDRLVFCSADSVDILMQSCSKYHKDIRSLQAELQYMNLSIQEKLMQYGLFSKPAQFSSNSTIYLGRNINRIAVIQEKIGAGSYMMTHEYTIDHRFDEIHSRILSEFSWDSIVFEGRASIDTFLAEIKRLGFINILTLPFSYTDVPTLHYANKVGFHNVDHQLQETLMKKDMVRQ

SEQ ID NO: 30303 - protein, 446 aa, Aquifex aeolicus
MNKNVFLVLAILVFFGVLITSPFEGNVNKGIAILLLAAILWITEALPLPVTALLIPVSGVLLGVFDVKTALSYFAHPLIFLFFGGFVLAVALSKYQIDEYIAHKIVSVAQGKFLPSVFLLMLATSLISMWISNTSTTAMMLPLALGILAGVRETEREKVFPFVLLGIAYSASVGGIGTLVGSPPNGIAAGILGLSFPDWLKFGIPVFLILFPLLFAILFLVFRPTSDLKVERVQEIKFEFTPQRVLVLLIFLFTALAWIFSKKIAPIFEVKKYFDTVVALLAVVALFIFRLLDWRDVKEGVSWGTLLLFGGGIALSGIMKKTGTAKFISQELVDVLHGLPTFLFLLTIVLFVIFLTELMSNTATTALIAPILFSTAQMIGKPPEMLVIPAAVAASCAFMLPVATPPNAIVYGTGYIKQSQMMRVGLILNIVFSIVLAAFFTVYVGG

SEQ ID NO: 30304 - protein, 643 aa, Desulfovibrio gigas
MCGIAGFVLLQDAPPVTDHQARDVLAAMAGRIAHRGPDGRGHHVGLPAAFAHCRLAIIDLSTGAQPMAAEDGAAVVTFNGEIYNYQEVRRELQALGRTFQTRSDTEVLLQAYLEWGVACLDRLEGMFAFALWDVRRRTLFAARDRFGKKPFFYTIQQGVFAFASELSALEAVPWAAFSIRASTLARFLAYEYVPTPESIYAEARKLPPAQYLELHEDGTLLVERYWETPMPRPEGSKGFGRADEPALCEELRRLLTQAVRRRLIADVPVGVFLSGGVDSSSVAAMAGQLAPGIKTFSIGFTEASYDESAYAGRVAAQLGTDHQLELLSADACADLLPEVVSRFDEPMADPSIVPTYLLSQITRRQVTVALGGDGPDELLAGYEYYPGFKATQYWERLPAWLRRAAVAASGLLPGSAGYVNPRHVAQTFLAAAEAPAWLRTQRMLTALTPEAQRALWKSPGDMLEPTRLFASTKRLWEALPDWPPMARVFHLFAQQITYGYILVKVDRCTMLHGLEARAPFLDRDLAEFCFRLPVSMKLRGATRKYLLKEAMAGLLPQDILHRPKRGFLIPTAAWLRGRLRPLVDDLLHERRLREQGLFHPAAVRRLVEEHASGKKDHRKGLWTMLVLQLWLAGKPAVRIDPER

SEQ ID NO: 30305 - protein, 578 aa, Kineococcus radiotolerans
MPDAAVSRPVLMTVDDDPAVSRAVARDLRRRYGQAYRVLRADCGDDAIAALREVKLRGGTVAAVLADYRMPQMDGVQLLEQAMDLFPTARRVLLTAYADTSAAIRAINDVDLDHYLLKPWNPPEEKLYPVLDALLESWHAAPPRPADEVVVIGDRWSARSFAVRDFLARNEVPYRWLRVDEAEAGRLLEAAGLGWTDDLGRLEGPIRLPVVLTPPRPGTSAAEGGRPAVLVDPDDTTLAEHVGLSTRPARDFYDVAIVGGGPAGLGAAVYAASEGLRTVMIEERATGGQAGQSSRIENYLGFPDGLSGAQLADRARRQVAKFGAETLSARSVTRLEVSGSARVLHFTDGTSVAAHTVLLATGVAYRTLQGPGVEQYTGRGIYYGAALSEANACADEDVFVVGAANSAGQSAVNLARSARSVTMLVRGPSIDASMSSYLIEQIAQRPNIRVLTCTEVVQARGGEHLSSIVLRDRAGGDEREVAAQHVFVFIGAEPRTSWLDGVVERDAKGFIVAGPDLHREGDRPPGWVLDRAPYHLETSVPGVFVAGDARAESVKRVASAVGEGAMAVMLVHRYLAQS

SEQ ID NO: 30306 - protein, 502 aa, Thermococcus kodakarensis
MFHQAKWDEPTIFELSRPGRIGYTLPKPIEDVDVDIPEKLRRKSPLNLPELSEPEVVKHYTRLSEMNYGVDSGIYPLGSCTMKYNPKINEEIASHPGVAYVHPYQDEGTVQGALKIMWELEQWLKEITGMDRFTLQPAAGANGEFTGVSIIRAYHIDRGETQRTEMLVPDSAHGTNPASAAMAGFKVIEIPSNENGTVDLEALENAVSERTAGLMLTNPNTLGIFEDEILEIAKIVHKAGGLLYYDGANLNAVLGKIRPGDMGFDVVHLNLHKTFSTPHGGGGPGSGPVGVKDFLKDYLPVPLVSYDAENDRYYLDYNVPRSIGKVKELYGNFAVIVRALTYLKIMGREGLKEVSEVAVLNANYLTQKLKGTRGYELPGKELRKHETVFSAEPMKKETGVKALDVAKRLLDFCMHAPTIYFPLIVHEALMIEPTETVSKEELDAYVEALKRISEEAYSNPEVVTSAPHNTAVRRVDDVLAAKKPVITWRMYRELKERGEIDY

SEQ ID NO: 30307 - protein, 395 aa, Arabidopsis thaliana
MKENKNCDNKIVQKYILAIEKLSLNQVHFHTKEQTVSIFARVSRLYYPTLNLVSKSFRCLLASPELYKVRSLLGNTESCLYVCSRFQDRHTNTTWFTLCRKPDQTLTNGTIKKSSGYVLARVSNLHSPPLHSSSLVAVGSNIYNIAGSSYLESSSSVSILDCRSHTWREAPSLREGLCSVSSSVLDRKIYVAGSCLDGDSYTYKNSFEVFDTETQFWDPDTITCSKTEGDFYGCGTACIDGEFHVVPVGQKREAVAYNSKEGRWDMVGQQMDHYKFSASCEIQNVLYSCTHGVFRWYDTNAMMWRDLKGLVGLPMFGSGANVKLADYGGKLTVLWEEELPSRGPDSGYKKMIRCAEIALERRKSCEIWGIVEWFGDVLTEPVGYVVLEKVLDVTL

SEQ ID NO: 30308 - protein, 451 aa, Thermococcus kodakarensis
MGKHYIPNSAHKDEMLKEIGFSSIEDLFSDVPKGMVKEFNLPEGKSEYEVFTELNETLSKNKTVLEMPSFLGAGTYFHYVPAHVKYLIERSEFLTAYTPYQPEISQGMLQALFEYQSLIAELVGLPIVNSSMYDWGTAMAEAALMSARVTKRNKFVVPKHLSPEKKLVLKTYTAGPGLETVEVPWDERGQMDIEKLKEAVEGAAGVYIEMPNFFGLLEENIREIGEIAHDAGALFVVGVDPTILGIVEAPGELGADIVVGEAAYFGNPMNFGGPRAGIFAVRNDRKLIRQMPGRIIGMTKDADGKRAFVMTLQTREQHIRRAKATSNICSNEALVAVAAAIHLATLGPKGVRELGEVILKNTAYLKKRLAEVGEIVFDGVNFKDVPVRFEVPYSVIHERLLERNIHGGYYIGKHFQELGETALFAATETTRKEWVDGLVDALREIIGEAEL

SEQ ID NO: 30309 - protein, 323 aa, Salmonella typhimurium
MSKIYEDNSLTIGHTPLVRLNRIGNGRILAKVESRNPSFSVKCRIGANMIWDAEKRGVLKPGVELVEPTNGNTGIALAYVAAARGYKLTLTMPETMSIERRKLLKALGANLVLTEGAKGMKGAIQKAEEIVASDPQKYLLLQQFSNPANPEIHEKTTGPEIWEDTDGQVDVFISGVGTGGTLTGVTRYIKGTKGKTDLITVAVEPTDSPVIAQALAGEEIKPGPHKIQGIGAGFIPGNLDLKLIDKVVGITNEEAISTARRLMEEEVFLAGISSGAAVAAALKLQEDESFTNKNIVVILPSSGERYLSTALFADLFTEKELQQ

SEQ ID NO: 30310 - protein, 344 aa, Oceanobacillus iheyensis
MEKVAVLGAGSWGTALAIVLADNGHEVRLWSHRKEHAETINETHRNHKYLDVDIPNEITAYSDMHQTVSGVDAVVIVVPTKAIREVCSELNKWMDSKTTVIHATKGIEPVSLKRVSEMIEEEMDIKYEDIVVLSGPSHAEEVALRHPTTVTTSSINLEKAKHAQDLFSSDSFRVYTSDDILGIELGGALKNIIALGAGISDGLGFGDNAKAALITRGLAEIARLGTSLGANPLSFLGLSGVGDLIVTCTSVHSRNWRAGNLLGKGNQLEDVLEQMGMVVEGVRTVKAAHQFAKDQNVDMPITSGIFQILFENKNPKDVVEQLMNRGKRDEMDDLAVLLKERYSE

SEQ ID NO: 30311 - protein, 470 aa, Listeria monocytogenes
MNNLKLSEEIKRAINELGYTEATPVQKAVIPVALTGEDIVAKSQTGSGKTAAFAIPIAEQVEWEENKPQALIIVPTRELAMQVKTECTNIGRFKRVKAAAIYGQSPFAKQKLELSQKNHIVVGTPGRLLDHIEKGSLNVDKVAHLVLDEVDEMLSMGFIDQVEDILSRLPKQRQNLFFSATMPEEMQDLIKRYQDNPMVIEMASEKTNPIFHVEMQTDNKEKTLKDVLITENPDSAIIFCNTKNQVDELTDLLDVKASKIHGGLRQEDRFRAMDDFKSGKSRFLIATDVAGRGIDVDNVSLVINYDLPIEKENYVHRIGRTGRAGKSGKAISFVKTNENPLLRDIEEMLDVTIEKKRKPTVIEVKVNEDAFRKKQQKRPTIKKARGEKLNKNIMKLYFNGGKKKKIRAVDFVGTISKLEGITAEDIGIITIEDHVSFVEILNGKGPAVLEMMRSRKVKGRRLKVNEARKR

SEQ ID NO: 30312 - protein, 328 aa, Gossypium hirsutum
MCSFSNKTAKGNMWIFGWKGPSGFSASSTAEEVTQGIDGSALAAIVTGASSGIGVETTRVLALRGVHVVMAVRNADAGRNVKESILKEIPSAKIDVMELDLSSMASVRKFASQYQSSNLPLNLLINNAGVMATPFMLSQDKIELQFATNHLGHFLLTDLLLETMKRTARESNIEGRIVNVSSEGHRIAYREGIRFDKINDESGYYTWYAYGQSKLANILHAKELAQRLKEEEVEITANSLHPGAIISTNLMRHHGLINTVGQMLGKYFLKNIPQGAATTCYVALNPQVKGVSGEYFLDSNIGNPSAKAKDADLAKKLWDFSCTLTNPK

SEQ ID NO: 30313 - protein, 164 aa, Triticum aestivum
  misc_feature (88)..(88): Xaa can be any naturally occurring amino acid
  misc_feature (104)..(104): Xaa can be any naturally occurring amino acid
  misc_feature (121)..(121): Xaa can be any naturally occurring amino acid
GDGSFQVTAQDVSTMLRCEQNSIIFLINNGGYTIEVEIHDGPYNVIKNWNYTGFVDAIHNGLGKCWTSKVKSEEELTAAIETALGEKXDCLCFIEVIAHKDDTXSKSCWEWGSRVSAANSXRPPNPQLVPAGSKPPVSLMIVTCSTVGAQPNNLNALPFPLRLF

SEQ ID NO: 30314 - protein, 376 aa, Oceanobacillus iheyensis
MSEESKDLQTMEVGTTVTGTVVKLEDKQVLVDIGYKTEGILPIGELSSLHVEATTDVLTEGDTVTLKVKKIDDDEIILSKRAIDSETAWEELEQKYNSGEAFDTTVKEVVKGGLVVDVGVRGFIPASLVETYYVEDFSDYLNKTLKVKIADLDRSQNRVILSHRAIVEDEEKNRKNDVLQSLEPGQVIEGTVQRITNFGAFVDLGGVDGLVHISQLAHEHVEKTSDVVSEGDKIKVEVLSVDLDNERISLSHKNTLPGPWANVEEQVKVGSTIEGTVKRLVSFGAFVELLPGVEGLVHISQIANRHIGTPQEVLEIGQTVQVKVLDVSEQDQRISLSIKELEEEQEAKEYKQYEKDDDQSGFQLGDFIGDKLDKYK

SEQ ID NO: 30315 - protein, 415 aa, Triticum aestivum
  misc_feature (174)..(174): Xaa can be any naturally occurring amino acid
RCVERDEEKRPCISEIINELNKIDNGIINEPDKNYSDIVDEQDKLNVHLVDEVDKIDGYIVDEQGKIDPDIVDKQDKLSTAKTSTTNLIPADRLDSLFTPRCVWVNGPIIIGAGPSGLAVAASLREHAVPFVMLEREDCIASLCRKRTYDSLKVNHPKQFCELPGMPLPDHFPXYLTRAHFMDYLQQYTTKFNIKPNFNNTVLSARFDETSGLWRVCARGAETDGNAKMEYISRWLVVATGAEAVVPDIPGLAGFCGEVTHSSDYSSGISYIGKRVLVVGSGQSGMEVSVDLCNGGAVPFMVVRNVLGIATLYLTVLLMWWLPLWLVDKIMALLAWIVFADLTRLGVRTPSVNSLTLKKTDDYGRAWRATARKIRSGEITVVTSVRRFTKSGAELSDDSVVDVDAVILATGYRSN

SEQ ID NO: 30316 - protein, 516 aa, Cryptococcus neoformans
MSAATTLPQWPPALEDDQLQSLTLLASVWSLAHGFTLLPHAPAHPPTSTIPAPLSLLPTPFPRQLYDLAVSLQPVYNALYARIALDWEFLDRVMGGSVSKVDDFQGELWRGWKSVRDQLVQRKQLGLFRSDYLLHEQDGGLGIKQVEFNTIAASFGALSQRAGELHKYLAKASRNYYDISPQLSNPANYPANEPLKKLATGLAAGWKAFGDEQAVVLFVVQDGERNVFDQTWLEFELLETHGIHSVRRTFSELSTLSLPSSSDLILPPSSQSSEPLRVALIYYRSAYTPTDYPTEKEWTTRIVLEKSTAIKCPSMALQLAGAKKIQQVLTEDGVLEDFLLGPERPDVGFGKGAGSLTKKDVDDLRSTWIGLYPMDNSALGQEANKLARQEPERFVLKPQREGGGNNIYRESIPPFLESLAATPVMEGEPDKKEGYILMELIQPPEKLENWLVRGGEGKPRKGEVVSELGVYGVTLFGGEETLNERAGTLLRTKGRESDEGGVAIGISSIDSPLLVD

SEQ ID NO: 30317 - protein, 173 aa, Vibrio fischeri
MDIININIINIFLFLYLEICYIIFLLYYNHIIKIIMESNMSDTIKTLLNLRSLRALSREMTLEQLEEALEKLQSVVAERQESEAEERAQLAEKQAKLEEFRQMMIDSGIAPEDLLDTMSATTVKTKQKRAPRPAKYKFQDHAGEEKTWTGQGRTPSALQAQLDAGKKLEEFLI

SEQ ID NO: 30318 - protein, 228 aa, Chlorokybus atmophyticus
MRSVTLEEMMEAGVHFGHQTRGWNPKMAPYIYGERNGIHLIDLIQTARLLSEASDFVLNAAKEGKEFLFIGTKNQAADIISSEALRCRSHFVNQRWLGGMLTNWPTIKTRIKRLKDLEQSEKNGTLDNLPKKESAVLKRQLDKLRKYLGGLQDMKTLPDVVIIVDQKREMNAVRECIKLGIPIIALLDTNCDPSLSDLPIPANDDAIRSVNLIISKLADAIYEGQGIK

SEQ ID NO: 30319 - protein, 91 aa, Brassica napus
  misc_feature (71)..(71): Xaa can be any naturally occurring amino acid
LLDLGINAVELLPVFEFDELELQRRPNPRDHMVNTWGYSTVNFFAPMSRYASGEGDPIKAAKEFKEMVKAXHSAGIEVMLDIVYNHANEAD

SEQ ID NO: 30320 - protein, 801 aa, Bacillus cereus
MKKRLVMIGNGMAGIRCMEEILKHDSDSYEITIFGDEPHPNYNRIMLSHVLQGKTNMQDIIMNEYSWYEENEITLYTNEKVQSINREEKIIITEKNRTLTYDKLIIATGSSAFILPVEGSTLPGVTGFRTIEDTQFMIDTANEKKKAVVIGGGLLGLEAARGLIDLGMDVHVVHLMPNLMEQQLDTKAASLLREDLEAQGMKFLMEKKTVKILGTDHVEGIQFEDGEVVDCDLIVMAVGIRPNTQIAKDAGLIVNRGIVVNDYMLTNDESIYAVGECAEHDGIAYGLVAPLYEQGAILAKHITNLQTDGYSGSIVGTQLKVAGCDLFSAGQIYEDDQTKAISIFDECKRSYKKVLIRDNKVVGIVLYGDTADGTRLFSMLKKEEDIQEYTPASLLHKAGEESEFDVATMSADDTICGCNGVTKGSIVHAILEQELTTFEEVKGCTKAAGSCGKCRPLVEQVLSHTLGDAFDASAQSAGMCGCTPLSRDEVVAAIHEKGLKSPKEVRNVLGFAHEDGCSKCRPALNYYLRMAIPEEYEDDKSSRFVNERMNGNIQHDGTFSVIPRMYGGVTTADDLMKIAEVAKKYDVPLVKITGASRIGLYGVKKQDLPNVWADLHMTSGYAYSKSLRNVKSCVGSRFCRFGTKDSLGLGMLLEQSLEMVDTPHKMKMGVTGCPRNCAEVLTKDFGVVCVENGYQLYIGGNGGTEVREADFVMIVPTEDDVLRIAAAYMQYYRETGIYGERTAYWTERLGFDHIKEILQDASMVTTLNERFQTARRTYTEAWGQALETKSLKAMYEVETVK

SEQ ID NO: 30321 - protein, 231 aa, Oryza sativa
MAGGGDDLKMLGVYVSPFPLRVKLALSFKGLSFEYVEEDLHNKSDLLVSSNPVHKRTPVVIHNGKPISESMVIVQYLDEAFPGAGAALLPSDPLDRAVARFWASYVDDKLFSAWKMVFKGKTEEEKVEGRKQTFAVAETLEGALRECSKGKPFFGGDAVGYVDVALGGFVPWVHAMEELFGLKQFDAAKTPLLAAWLERVGELEAYKAVMPDAGMMIEFKKKQAQEAAAEA

SEQ ID NO: 30322 - protein, 214 aa, Herminiimonas arsenicoxydans
MAKKKLNKNWLHDHINDPYVKLAQKEGYRARAVYKLKEIDESEKLIKPGQIIVDLGCTPGSWSQYVRNKLSGSVGGGINGIIIGLDMLEMEPIADVHYIQGDFREQNVLEQLEVVLAGRKVDLVLSDMAPNLSGIAVADAARMMDIIELAIDFAQHHMKPSGSLLVKCFNGSGFNDIVEKFRHEFKTVTQKKPKASRDKSSEIFLLGKTLKNPL

SEQ ID NO: 30323 - protein, 149 aa, Bacillus thuringiensis
MGYIEELRKVVGSRPLNLAGVAVAVFNEQGQILLQQRQNGIWGVPGGFVELGESTEEAGRREVFEETGVEIGTLQLISVFSGKEFFVKLPNGDEFYPITIAYLCKDIKGGLLKADGIESLSVQFFDFDKLPENISPFIKKLIEQNLVSI

SEQ ID NO: 30324 - protein, 168 aa, Glycine max
  misc_feature (49)..(49): Xaa can be any naturally occurring amino acid
  misc_feature (145)..(145): Xaa can be any naturally occurring amino acid
MIYSPSVTTVNRAGADMGATFTDLNSMAGFPIIKTNNDITSIDTNNGRXQCIQVWPPIGNKKFETLSYLPYLDDAQLAKEVEYLLKKGWIPCLEFKSEHGFLCREHNKTPGYYYRRYCTMWKLPIEGCTDANNVVEEDKHDKTAXPNWLISIFRNDNEMQVHCISVNY

SEQ ID NO: 30325 - protein, 447 aa, Magnetospirillum magnetotacticum
MALPDLSEPQVVRHYTRLSQKNYGIDTGFYPLGSCTMKHNPRLSEKVARLSGLADLHPLQPQKTVQGALEVIDSLAHWLKELTGMPAVAMSPAAGAHGEWCGLMAIRAAHEDKGENHRRRVLVPESAHGTNPASAAMCGFTVDPIPALENGRVDLAALKAKLGPDVAALMLTNPNTCGLFETEIVEIAAAVHGAGAYFYCDGANFNAIVGRVKVADLGIDAMHINLHKTFATPHGGGGPGAGPTVLSQALAAYVPVPYVVHGPKGLELVEGKRDGAKPFGRVKGFHGQFGVFVRALAYILSMGSDGLRQASSDAVLNANYLLASLKDDLSASFEGPCMHEALFDDRFLKDSGVTTLDFAKAMIDEGYHPMTMYFPLVVHGALLMEPTETESKETLDQFIAVVKGLAAKAKAGAAEEFKSAPRLTPRRRLDETLAARSPVLRWKPAAE

SEQ ID NO: 30326 - protein, 258 aa, Triticum aestivum
  misc_feature (115)..(115): Xaa can be any naturally occurring amino acid
VSREQRWSLAGATALVTGGSRGIGHAIVEELVGLGARVHTCSENAAELEECRRRWEETKLPVTVSVCDVSVRAEREKLMETAKQTFDGKLDILVNNVGRNVAKAAVEWTAEEYSXLMSTNLEAAFHLSQLAHPFLRDASIAGGGSVVNISSVASSLGYPTLALYCISKGGVNQLTRSLAAEWAQDKIRVNSVAPGGINTELQNSVDPKVIENTLLRTPMHRLGEPVEVASMVSFLCMPAASFLTGQVIYVDGGRTISG

SEQ ID NO: 30327 - protein, 600 aa, Triticum aestivum
MTNNNGNGNGGSNAAASGWLGFSLSPHMDEHNHVQQQQQHQGLFYPSSVAAAYSLGGDVATGGYYSQLASMPLKSDGSLCIMEALRRTDQQDHNGPKLEDFLGAGQPAMALSLDNTSNFYYYGGGGGAGGQHGQSHGGCFLQQAYDVYGGPATASVLAADEDAAAATAMANWVQVARGATAYATAENVLSAAADRQQHLHHHPLALSMSSAGSLSSCVTAGAEYGGVVATVDGGRKRGGATAGQKQPVHHRKSIDTFGQRTSQYRGVTRHRWTGRYEAHLWDNSCKKEGQTRKGRQVYLGGYDMEEKAARAYDQAALKYWGPSTHINFPLEDYQQELEEMKNMTRQEYVAHLRRKSSGFSRGASMYRGVTRHHQHGRWQARIGRVSGNKDLYLGTFGTQEEAAEAYDIAAIKFRGLNAVTNFDITRYDVDKIMASNTLLPGELARRNKDANAAPLPLPAPDDCAASALVPVSTPGTDTGGSGQHRHHDVMSSGEAFSALHDLVTVDGHTAQGGNGAHVHMSMSGASSLVTSLSNSREGSPDRGGGLSMLFAKPPQQPATTTAASPKLMSTLAPLGSWASSARPAAVSIAHMPMFAAWSDA

SEQ ID NO: 30328 - protein, 188 aa, Griffithsia japonica
MLTARFSALRGAARRYLATPAVNPASASVSVLNQPLSAVDPDMFDIIEREKARQIKSIQLIPSENFTSKAVLETIGSIMTNKYSEGYPGARYYGGNEFIDMSERLCQKRALEAFNLDPQKWGVNVQALSGSPSNMAVYTALLKPHDRILSLDLPHGGHLSHGFMTDKKRVSATSIFFESMPYRLDEQT

SEQ ID NO: 30329 - protein, 151 aa, Chenopodium rubrum
ALLLLLSVSQGNAIDPRKIQEHFEDFYEDLFEELNKYGEIESLNICDNLADHMVGNVYVQYREEEEAANAHRNLSGRFYAGRPIIVDFSPVTDFREATCRQYEENNCNRGGYCNFMHLKRISRELRRQLFGRYRRRHKQKQKQKPIQTQKL

SEQ ID NO: 30330 - protein, 192 aa, Aquifex aeolicus
MREAEVFRETRETKIKLYINLDGSGNYEVNTPVGFLTHMLESFAKHGRFDLKVEAEGDVHVSHHHTVEDCGIVLGQAVLKALGDKKGIRRYGYSIIPMDEALVLSSIDISGRPLFFYEDKDLRGKITEFDFELIWEFFKGFALESRSTLHIKVLDGKILHHVAEACFKSFAITLKEAVKVEGSGVPSTKGVI

SEQ ID NO: 30331 - protein, 494 aa, Oryza sativa
MVGAGEGDRVGGGAAVGGGQQFVDRSKVRILLCDSDPSSSREVLRLLCNCSYQVTCAKSPRQVINVLNCEAGEIDIILAEVDLPVSKCFKMLKYIARNKELRHIPIIMMSNRDEVSVVVKCLRLGAAEYLVKPLRMNELLNLWTHVWRRRRMLGLSEKNFFNDNFELALSEPSDANTNSTTLLSDDTDDKPKENINQETSTSNQHEYESNPSDAEPKQKGTPEGLLVSTEGGDQASYVKSSTPTTSSFDSELQKGGNRLDSSDHRGNFSSTTDRSDTGTDVNIRDKEAFEMPVQYPVVCFSSSNLHLERSNEGQNDASGTPPVYHFPFYYPGMMDHGMTHPPVQNFQGNINNAQVHTPQTLLPQYNVYPQCHGVSMMPPFQYNPAGMSIQSNQLPTQNMWPQASSTPMPEETCSRSERRAAALAKFRLKRKERCFDKKVRYVNRKKLAETRPRVRGQFVRQANYTDITSTGDDISEDEDDDPSSREVEMVSSPE

SEQ ID NO: 30332 - protein, 337 aa, Debaryomyces hansenii
MVVYFDPNTAPFLNPAVDRRVAFITGGNSGIGWFTILHLYLHGYTVYVAGRTESKVRKAIEDIKIEAEKRVKEYTKEEQDARSLGSLDYVYLDLLDLSTVVAAAESFSKKEPELHILINNAGIMGVPYEETKDGYEIQYQVNFASHFLLTFKLLPLIKKVALKGSIQPRIIQLTSGGHRASYRYFQPSENMNKFPNILYTWYRYGAAKLASIQFMNLLGKANPDILCVSVHPGIIFGTELFKYWKKMPIFGYLSSASMYAVAPLIGVQIEEGSLSTLKTALDPKINLLQDNGKYYVTGGSEGSTSRVAQNEKDAITTWNWNLDYMRKHNFNIDAPKL

SEQ ID NO: 30333 - protein, 467 aa, Listeria monocytogenes
MTSVMWFRRDLRVNDNKALYHACKEDDLLLLFQVNPAQFITGSPSHQAFFASVAHFKQEVDKTALLQIMFGEPVECLKQLKETLPSWDKVYFNRDETGYGAERDEAAKTFFDEQEIEVQAFHDSYLHSAEEVKKSPTEYYKIFTPYYKKWREEIKETPFKVTLKADNIRKENLFPKYEEQFAEMTCDLPILDSGEKTANTRLANFIKHDVADYDKARDFPELDKTSHLSRYLRTGEISVRTIWQALQENEATEGRAIFEKELCWRDFYNMIYVSFPNQKNEPIQENYRFIEWENNREFFKAWQEGKTGFPLVDAAMRQLKETGWMHNRLRMVTASFLTKDLLIDWRFGEKYFQQMLIDYDPASNIGGWQWAASTGTDAVPYFRIFNPTTQSQKFDPTGKFIRKYVKELANLPDKFIHQPEKMSEIEQKEYGLLLGKDYPFPLIDHKERRKLAIARYEFSKEHYRGNI

SEQ ID NO: 30334 - protein, 540 aa, Mannheimia succiniciproducens
MNDNWWKNGVIYQIYPKSFQDTTGSGTGDIQGIIKRLDYLQTLGIDGIWITPMYVSPQIDNGYDIADYRNIDPSYGTMADFEQLIAEAHKRDIRIVMDMVFNHSSTFHQWFKQGEDPNSEYHDYYIWREQPTNWQSKFGGNAWKWSDKAQKYYLHLFAPEQADLNWENPKLRAELYDICRFWAEKGVDGLRLDVVNLISKPEKYEDDFEGDGRRFYTDGPKIHQYLQELNQNALKPFGLMTVGEMSSTKLEHCQRYANLDGSELSMTFNFHHLKVDYPNGEKWTYAKPDYVELKSIFNYWQKGMHGKAWNALFWCNHDQPRIVSRFGDEGELRTLSAKMLAMLLHGMQGTPYIYQGEEIGMTNPNFSSIEEYRDVESLNAYQILQNQGKSAVEILQILAQKSRDNSRTPVQWDASPNAGFTSATPWIGVAKNYPQINVEQALADRDSVFYTYQKLIALRKQLAVLTDGDYSDLLPNHESVWLYQRSTAGERLTVAANLSNQPQFIEIKPQGQVLINNYADITQEDSGICLKPYQALYFLA

SEQ ID NO: 30335 - protein, 682 aa, Helianthus annuus
MSSSNDNNNNFINNPLTSTKDLFPSTSLSLTLGLFRDGEDAVDDRKEEAANTTVTEISSETSGPVRSRSDDDDFDADPDVDDGDDASNKNNKSKKRKKYHRHTADQIREMEALFKESPHPDEKQRQQLSKRLGLHPRQVKFWFQNRRTQIKTIQERHENSLLKSELDKLGEENKLLRETIKKGTCTNCGFGSSSKDVHTYVDEQQLRVENAKLRAEIEKLRNISWGNIHREHHQRNSCSVGNDHENKSSLDLCSGLFGLEKSRVNGGCRSGLWKSFVQMASAGAPLWVKSLETGREILNYDEYLTKFSTVDSSNVQRLRFIEASRDSGVVFVDLPQLVRSFMDVKEFKEMFPCMISKAATLDVICNGEGPNRKGAVQLMFAELQMLTPLVATREVYFVRYSKQLTAEKWAIVDVSIDNVEKNIDASLARCRKRPSGCIIEDKSNGHCKVTWIEHWECQKSVSHSMFRAIINSGLAFGARNWMATLQQQCERLVFFLATNVPTKDSCGIGTLAGRKSILKLAQRMNVRVLVRALGASSYHTWKKIPSKTGYDIRASRKNLNDAGEPLGVILCAVSSIWLPVSHTLLFDFLRDETRRNEWDIMSNGGPVQSIANLAKGQDQGNTVSIHTMKWKENMWMIQDSCTNAYESMVVCAPVAVTAMQSIMAGCDSSNIAILTLGFFNST

SEQ ID NO: 30336 - protein, 239 aa, Zea mays
  misc_feature (188)..(188): Xaa can be any naturally occurring amino acid
  misc_feature (199)..(199): Xaa can be any naturally occurring amino acid
  misc_feature (203)..(203): Xaa can be any naturally occurring amino acid
  misc_feature (213)..(213): Xaa can be any naturally occurring amino acid
  misc_feature (218)..(218): Xaa can be any naturally occurring amino acid
MAAAGGGVGDSELRLLGKSSSPWVFRVRVALGLRGLSYEYIEEDLGNKSELLLRSNPVHKKVPVLIHGGRPVCESLVILQYVDEIWRGTGPPLLPSDPYDRATARFWAAYVDDKFFPAFSALFRSRTDEQRAEALQNALLVAETLERAFTECSRGKAFFGGDAVGLVDVTLGSHPIWIRAVDQTAGTXLPDGARFPDLXAWAXRFMALGAVNXVVPDXGKLLEQYRASRAKWTASADSS

SEQ ID NO: 30337 - protein, 385 aa, Unknown
  Sulfitobacter sp. EE-36
MAKRDYYETLGVAKGASADEIKKGYRTKAKELHPDRNADNPNAEAQFKEANEAYEVLKDPEKKAAYDRYGHAAFEGGMGGGGGHRGGGFGGGGQGDFSSAFSDVFDDLFGDFMGGQRGGGGRRAARGADLRYNLGITLEDAYRGMQKSINVPTSVACDSCNGSGSEGGAEPTTCPTCSGMGKVRAQQGFFTVERTCPTCSGMGQIVKNPCKSCRGAGRVEKDRALSVNIPAGVETGTRIRLAGEGEAGMRGGPSGDLYIFIEVQDHKLFERDGPNLFCRVPVSMSTAALGGSIEVPTIDGGRGRVQIPAGSQSGRQMRLRGKGMPPLRGGGTGDMIIELAVETPVNLTSRQKELLQEFEKESSNNNPESSSFFSSVKSFWDSMKG

SEQ ID NO: 30338 - protein, 231 aa, Brassica napus
DRRLGSGSFKIPAATYTVFLMLGMTIFIPYSTTRVLVPFLRKYTGRDGGITQLQRVGAGLFLCITSMMVSAAVEQHRRTVALTRAPLGVAPRKGAISSMSGMWLIPQLVLMGIGDALAGVGQMEFYYKQFPENMRSLAGSLYYCGIGLASYLSSFLLSAVHDVTEGSSGGNWLPEDLNKGRLEYFYYFVAGMMTLNFAYFLLVSHWYRYKDVVVKDKDMDKSCDEFDKVSV

SEQ ID NO: 30339 - protein, 149 aa, Oryza sativa
MSALHLSSSLSFSFSLGAAGGARRGAVCCRVGGREVLKTCGTTPLLRAVPVLLRAAAAGGLSRALRLQSCRYSCGECLFPEAQPFPHADFADEVAYLDGALPCEVLLFRHSAVMPPSSSPGASHRWHVYLASSSSSSFVARRGSRWRCA

SEQ ID NO: 30340 - protein, 320 aa, Exiguobacterium sibiricum
MTETEQKIYDVIIIGAGPAGMTAALYASRANLSTLMIERGIPGGQMANTEDIENYPGYDSILGPDLSQKMFDHSKAFGAEYAYGDVRSIEDGPAFKTVHAHNKDYHARAIIIASGAQYKKIGVPGEEELGGRGVSYCAVCDGAFFKEKELFVIGGGDSAVEEGVYLTRFAKKVTIVHRREELRAQKILQKRAFDNPKIDFIWNHTVKQINEDNGKVGGIELINTKTAETTTYPIDGVFIYIGMNPITGYVQDLGILNDQGYVVTNEAMETNIKGIFAAGDVREKTLRQVVTATNDGSIAAQNAQHYIEALLEELQESSQV

SEQ ID NO: 30341 - protein, 426 aa, Oceanobacillus iheyensis
MVADKAADSSNVNQENMDVLNTTQTIIKSALDKLGYPEEVFELLKEPMRILTVRIPVRMDDGNVKVFTGYRAQHNDAVGPTKGGIRFHPNVTETEVKALSIWMSLKSGIVDLPYGGAKGGIICDPREMSFRELEALSRGYVRAVSQIVGPTKDIPAPDVFTNSQIMAWMMDEYSKIDEFNNPGFITGKPIVLGGSHGRESATAKGVTIVLNEAAKKKGIDIKGARVVIQGFGNAGSFLAKFLHDAGAKVVAISDAYGALYDPEGLDIDYLLDRRDSFGTVTKLFNNTISNDALFELDCDIIVPAAVENQITRENAHNIKASIVVEAANGPTTMEATKILTERDILIVPDVLASAGGVTVSYFEWVQNNQGFYWSEEEIDNKLHEIMIKSFNNIYNMSKTRRIDMRLAAYMVGVRKMAEASRFRGWV

SEQ ID NO: 30342 - protein, 727 aa, Unknown
  Acidovorax sp. JS42
MSIFNKVTKSFQWGDKTVVMETGEIARQASGAVLVNIDDTVVLATVVGSKQAKPGQDFFPLTVDYIEKTYAAGKIPGSFFKREAKPSELETLTSRLIDRPIRPLFPEGFYNEVHVVIHTISLNPEVDADIAAMIAVSAALSVSGIPFNGPIGAARVGYVNGEYVLNPGQTARKSSQLDLVVAGTEAAVLMVESEAQQLSEEIMLGAVVFGHEQGKVAINAIHELVRDAGKPVWDWQPPAKDETFIAKVTALAEGKLRAAYQIRSKQARTQALREASASVLESLKGEGVEFDAVKVEALLFDIEAKIVRSQILAGEPRIDGRDTRTVRPIEIRNSVLPRTHGSALFTRGETQALVVSTLGTERDAQRIDALAGEFEDRFIFHYNMPPFATGEVGRMGSTKRREIGHGRLAKRALVACLPSKDEFPYTIRVVSEITESNGSSSMASVCGGCLSLMDAGVPMKAHVAGIAMGLIKEDNRFAVLTDILGDEDHLGDMDFKVAGTTNGITALQMDIKIQGITKEIMQVALAQAKEARMHILGKMQEAMGEAKTEISSFAPKLYTMKINPEKIRDVIGKGGATIRALTDETGCQINIEEDGTITIAATEAAKADEAKRRIEEITAEVEVGKIYEGPVTKILDFGALINLLPGKDGLLHISQIAHERVEKVGDYLQEGQIVKVKVLETDDKGRVKLSMKALADRPAGDSGRPAPAERGERRERRDGGASEQQQQ

SEQ ID NO: 30343 - protein, 305 aa, Arabidopsis thaliana
MASVAPKIAKDVTELIGNTPLVYLNKVAKDCVGHVAAKLEMMEPCSSVKDRIGYSMIADAEAKGLIKPGESVLIEPTSGNTGVGLAFTAAAKGYKLVITMPASMSIERRIILLAFGAELILTDPAKGMKGAVAKAEEILAKTPNGYMLQQFENPANPKIHYETTGPEIWKGAGKYLKEQNTNIKLYGVEPVESPILSGGKPGPHKIQGIGAGFIPGILDVDLIDEVVQVSSEESIDMARLLAREEGLLVGISSGAAATAAIKLAKRPENAGKLIVAVFPSFGERYLSTVLFDAARKEAETMTFEP

SEQ ID NO: 30344 - protein, 415 aa, Listeria monocytogenes
MTELIKKGSAAKEAAQFLAQASTKQKNAALLNLSNDLLTHTASLLEENNKDIIRAREKGTPETMIDRLRLTEERIKEISEAVKQVVALKDPIGEVTNMWKNEAELTIGKTRVPLGVIGIIYESRPNVTVDASVLCFKTGNAVILRGGSDAIDSNKALMSVIQDSLEASGFPRSSVQLIEDTSRETARDMMRLNRFLDVLIPRGGAKLIQTVLENATVPVIETGTGNCHIYVDKAAEKQMAIDILVNAKCSRPSVCNAAETLLIHRDVADAFLPEIETALKEYNVELRADERAREILKDSKAATESDWEDEFLDFILAIKVVDSVDEAINHINKYGTKHSEAIISNDYATGQAFHQKVDAAAVYINASTRFTDGFAMGFGAEIGISTQKLHARGPMGLTELTSTKYIIFGDGQIRN

SEQ ID NO: 30345 - protein, 341 aa, Unknown
  Frankia sp. CcI3
MRIGVLTGGGDCPGLNAVIRAVVRKGESVYGHSFVGYRDGWRGPLTGETVPLDIAAVRGILPRGGTILGSSRTNPYAAVDGPALVREHLAAAEVDALIAIGGEDTLGVAAQLHAEGLPVVGVPKTIDNDLSATDYTFGFDTAVNIATEAIDRLHTTAESHHRVLIVEVMGRHAGWIALHSGMAGGANVILIPERPFDFDKVCAFVEARFATHYAPIIVAAEGAVPITGTLVAREGEVDAFGHVRLQGIGAVLETEIRARTGRDARATVLGHLQRGGTPTAFDRWLATRFGLHAVDAVHEGDFGVMVALHGTRIDRVPLQDATRELKTVPEELYHEAEIFFG

SEQ ID NO: 30346 - protein, 549 aa, Pseudomonas fluorescens
MKNLHRCKKIFLRVFSRSARRQREPLQDAVLDLHQGAFGGFAPCSAPVQLKRKRPMTKPETTAPTAKAVLPIGLLIAVLAMVAVLLLPLPADLPVAGHRMLAILAFAVVVWISEAVSYEASAIMITALMAFLIGTAPTLQDPSQLYGSSAAIGLALTGFSNSALALVAGALFIAAAMTHTGLDRRIALVTLTRVGTSTRRILIGAIAVTILLSLLVPSATARSACVVPIMMGVIAAFGVDKRSNIAAGLMIVVAQGTSIWNVGIQTAAAQNLLTVGFMDKMLGQRVAWLDWLIAGAPWAVIMSLVLLWLVLKLLPPETDSIPGGKEAVAQSLADIGPMTGPQKRLLTVSVLLLLAWSTEGKLHPFDTTTTTYAGLVILLLPRIGIMTWKDVQSRIPWGTVIVFGVGISLGSALLSTQAGQWLGSQVVAHTGLDQVGPLAVFAILAAFLILIHLGFASATALTSALLPILIAVLQTLPGEFSRLGMTMLLGFVVSYGFILPINAPQNMVCLGTETFNARQFAKVGLLVTLIGYLLMLVFAMTWWKWLGWM

SEQ ID NO: 30347 - protein, 521 aa, Salmonella enterica
MLDTNMKTQLRAYLEKLTKPVELIATLDDSAKSAEIKELLAEIAELSDKVTFKEDNTLPVRKPSFLITNPGSQQGPRFAGSPLGHEFTSLVLALLWTGGHPSKEAQSLLKQIRDIDGDFEFETYYSLSCHNCPDVVQALNLMAVLNPRIKHTAIDGGTFQNEITERNVMGVPAVFVNGKEFGQGRMTLTEIVAKVDTGAEKRAAEALNKRDAYDVLIVGSGPAGAAAAVYSARKGIRTGLMGERFGGQVLDTVDIENYISVPKTEGQKLAGALKAHVSDYDVDVIDSQSASKLVPAATEGGLHQIETASGAVLKARSIIIATGAKWRNMNVPGEDQYRTKGVTYCPHCDGPLFKGKRVAVIGGGNSGVEAAIDLAGIVEHVTLLEFAPEMKADQVLQDKVRSLKNVDIILNAQTTEVKGDGSKVVGLEYRDRVSGDIHSVALAGIFVQIGLLPNTHWLEGALERNRMGEIIIDAKCETSVKGVFAAGDCTTVPYKQIIIATGEGAKASLSAFDYLIRTKIA

SEQ ID NO: 30348 - protein, 183 aa, Salmonella enterica
MQNSLLNTHVTTIDGEVTTLEKYAGKVLLIVNVASRCGLTPQYEQLENIQKAWADQGFVVLGFPCNQFMGQEPGSEEEIKTYCASTWGVTFPMFSKIDVNGDARHPLYQKLIAAAPTAVAPEKSGFYERMVSKGRTPLYPDDILWNFEKFLVGRDGQVVQRFSPDMTPEDPIVMESIKIALAK

SEQ ID NO: 30349 - protein, 336 aa, Pseudoalteromonas tunicata
MTTAKYAVSVLGAGSYGTALAICLARNNHAIGLWGRDASHIETLAKDRANERYLPGAAFPESLSLESDLQTVVSQSNTILVVVPSHAFAQALISIKPFLQPGSKVAWATKGLEPNTGRLLQDVAREILGDEISLAVVSGPTFAKEMAMGLPTAISVSSTDPLFVKQLSDYLHCGRSFRVYSNDDFIGVQLGGAVKNVIAIGAGISDGFGFGANARTALITRGLAEMCRLGCAMGAKPDTFMGMAGLGDLILTCTDNQSRNRRFGLALGQGSDVEKAQTEIGQVVEGYRNTKEVYLLAKRVGVEMPITEQIYQVLYEGKNVKEAAMSLLGREKKAES

SEQ ID NO: 30350 - protein, 329 aa, Ostreococcus tauri
MYREPCCWWPIGHLRGWKGPSGFGAQSSWRDVLLGLPMELMRKKCILLTGATSGIGLETLRAFAHTGALIIVGTRNEHDANIMANQLMRETGAVIQVFPLDLGNLESVERFAEGIFKLDKEIDILVNNAGLMPCPFAGRDEAWHVNFIGHYALTKKLLPHMAPGARIINVSSEVYRFSYPCGVRFNAIDDANGYDAVKSYGQSKLALMLWTSHQSQAFRSDKRELQIFAVHPGSVKTQGAEDARSSSGWRGALLHCIGAPFVKSLEAGASTTVYCALHPTARSYNHFGLVYYANCNPRQLNRQANDPVLARRVCEFADSFIASARNRSN

SEQ ID NO: 30351 - protein, 267 aa, Thermotoga maritima
MRVAAVQMLPAIGDFEGNLERIEQFIEMAVSEGAEVVVFPELTISGYTWDEAILKRGALFFSEVAKKKLLKLSREGQILIAVGTPRVVLGKLRNSLVIFKKKKELLFYDKTHLFRGEKNVFEPGEYFLVFSYRGVVFGTLICYEIGFPEISRILTFKGSKVILSAFAFGKARGHTYDVATRSRAVENGVFLVASSMCGEGFVEFVGRTRIVGPNGKVMNEIESGEGLICEDLDLDAVYHYRYDEEGDSHAYLRNYISHLYTLQKGRL

SEQ ID NO: 30352 - protein, 506 aa, Unknown
  Nocardioides sp. JS614
MFVLVTIAVQTGWGPVTSIDNRGQGAETWAVDERWLRLPLRWIEVGFGAIGTWVIVGVLAVLLFVRQHRRAAVYAVGVVAVTKIATTILKAVFGRHRPDWQNPEHLLDSNAYPSGHSSTIVALVGVAAVLVMMLVRRRSARHTAYALLAVLAVVVGLDRVLLGRHFPSDVVGGALLGAIVVLLGIVVQNPLPRSHAASVEPLPEVFGSEHRLTVILNPVKVEDVGQFEALVTAMAAEAGWSAPTWHYTTVEDPGTGMAEAAAVAGTDLVLVCGGDGTVREVCAELAGTGIPVGIIPAGTGNLLARNLDIPLYLRAAIDVALTGQDRAIDLVEVSGDGFEDTHFMVMAGMGFDAAIMEGVNEDIKKRVGWLAYVLSALKSLMFPAVRVEVSVDGGEFTRHRARTIVVGNVGFLQAGMPLLPDAAIDDGVLDVVMLHPRRFLSWIPLAYRVLARRPRTDELVNRMTGHTVVVRASTDTPRQLDGDSIGPGRELRMTCVHGRLLVRVPR

SEQ ID NO: 30353 - protein, 291 aa, Saccharomyces cerevisiae
MSASKILSQKIKVALVQLSGSSPDKMANLQRAATFIERAMKEQPDTKLVVLPECFNSPYSTDQFRKYSEVINPKEPSTSVQFLSNLANKFKIILVGGTIPELDPKTDKIYNTSIIFNEDGKLIDKHRKVHLFDVDIPNGISFHESETLSPGEKSTTIDTKYGKFGVGICYDMRFPELAMLSARKGAFAMIYPSAFNTVTGPLHWHLLARSRAVDNQVYVMLCSPARNLQSSYHAYGHSIVVDPRGKIVAEAGEGEEIIYAELDPEVIESFRQAVPLTKQRRFDVYSDVNAH

SEQ ID NO: 30354 - protein, 497 aa, Bordetella bronchiseptica
MTAPAAVPAPQSPPKVKIPIGLIAGIIAMVVVLLLPLPAELPPAGHRMLAILAFAVVVWITEAVSYEASAIMITTLMAFLLGTAPNVKNPDVLYGTSAAISMALTGFSNSALALVTGALFIAAAMTFTGLDKRIALVTLARVGTSTRRILLGAIAVTIVLSLVVPSATARSAAVVPIMLGVIAAFGVDKRSNIAAGIMIIVAQATSIWNVGIQTAAAQNLLTVGFMDKMLGERVAWSDWLIAGVPWSLLMSAVLIFVVLRLLPPESDAIAGGKEAVEASLRELGPMTSAQKRLMLVSIMLLLFWSTEGKLHKFDTTSTTYFGLVLLMLPRFGVMTWKDVQTRIPWGTVIVFGVGISLGTALLTTQAGQWLGAQVVTHTGLDHLGPLGIFAILSAFLILIHLGFASATALTSAMLPILIAVLQTLPGDFNRLGMTMLLGFVVSYGFILPINAPQNMVALGTETFTAKQFAKVGIVLTIVGYLLMLLMSVTYWRWLGWM

SEQ ID NO: 30355 - protein, 112 aa, Corynebacterium diphtheriae
MKLVTAIVKPFTLTDIKDSLEQVGVHGMTVTESQGFGQQKGHTEVYRGAEYAVDFVPKIKIEIVINDDLLDDVVKAIVDSAHTGKIGDGKVWVTTVDDLIRVRTGERGDSAV

SEQ ID NO: 30356 - protein, 570 aa, Candida albicans
MSEHKWWKEAVVYQIWPASYKDSNGDGVGDIPGIISTLDYIASLGVTTVWLSPMYDSPQDDMGYDVSDYENVYSKYGTLQDMDRLIAGCHDRGLKLILDLVINHTSVEHKWFKESRLSKDNPKRDWYIWKPPRIDSNGNKHPPNNWGSYFSGSAWKYDELTGEYYLHLFAESQPDLNWENKECREAIYNSAIKFWLDKGVDGFRIDTAGMYSKYQHFKDAPVAFPDTEFQPCEIYHKNGPRIHEFHKEMAKVMEPYDTMTVGEVGHSTREQALKYVSAAEKEMNMMFLFDVVELGSDPRDRFRYNGFDLVDLKKAIKSQGEFAEGTDAWSTVFIENHDQARAISRFGNDSPEFRVLSGKAIAMLQCCLTGTLFIYQGQEIGMTNVPRSWPIEEYKDINTINYYRAFKEKYGKDADYKQKEEKLVDVINRLARDNARTPVQWSHQQYAGFSEVEPWMRVNDNYKEINVEDQDGDDHSLLNFYRKLLKLRGEYKDLFVYGEMKFLDFDDKKLFTFAKEAPGSPVAYIVINFSGEDVKFEPLIKGNYKLVLTNVDKDSKDALSPYEARMYVVD

SEQ ID NO: 30357 - protein, 586 aa, Oryza sativa
MVDRRMAFAAEADVDSKAAFGFFGGECFVGEGDLVNPAPPPPQQQQVHEGGFAAEDESDGDDDDDDDDDVDDIEELERRMWRDRVRHKRLKELQQSRAGRESRAGDAGGGGRQQRQSQEQARRKKMSRAQDGILKYMLKMMEVCNAQGFVYGIIPEKGKPVSGASDNLRSWWKEKVRFDRNGPAAIAKYQADNAVPGCDGDAGGAAPAGPHSLHELQDTTLGSLLSALMQHCDPPQRRFPLEKGVPPPWWPEGSEAWWPEAGVPKELGPPPYKKPHDLKKAWKVAVLTAVIKHMSPDVDKVRRLVRQSKCLQDKMTAKEIVTWLAVLKQEEDLYLKLHPGALPPPLSAASFNASVSGEYDVEGVDGDEAGNNNLQKAQNDATAFMDLTTTMDAALSNNKFLIMPLMKEEAIDVDFIQKRSEPELMLSSDSHARVYTCGNVQCPHSNYALGFLDRNERNAHQYACKHNAAAAAAESKPPPPHIFEPLGSFDFDLPVDGQRCLAGLMTMYDNDVAAATQMHHHHHQQQQANFFIRDDAPFGGDVAATAAAAPEFRFSSNFNVTGGGAVDYGGAMQQPPAKYAGSNWFY

SEQ ID NO: 30358 - protein, 315 aa, Betula pendula
MENFPVINMEKLNGDERGATMAKINDACENWGFFELVNHSIPHEFLDNLERLAKEHYKKCLEQRFKEMVASKALEGAKAEVNDMDWESTFHVRHLPQSNISEIPDLEDEYRNVLKEFALKLEKLAEELLDLLCENLGLEKGYLKNAFYGSNGPTFGTKVSNYPPCPKPDLIKGLRAHTDAGGIILLFQDDKVSGLQLLKDGQWIDVPPMRHSIVINLGDQLEVITNGKYKSILHRVIAQTDGNRMSIASFYNPGSDAVIYPAPSMVEKETEEKNVYPKFVFEDYMKLYAGLKFQAKEPRFEAMKANGKLGPIATA

SEQ ID NO: 30359 - protein, 352 aa, Betula pendula
MKRMLSTQPLADSDPSFAQRIRDLPKHVPGTNIKNEVSQLIGRTPLVYLNKVTEGCGAYIAVKQEMMQPTASIKDRPAYAMMMDAEKRNLITPGKTTLIEPTSGNMGISLAFMAAMKGYKMVLTMPSYTSLERRVTMRAFGADLVLTDPTKGMGGTVKKAYDLLESTPNAFMLQQFSNPVNTQGAFETTGPEIWEDTNGQVDIFVMGIGSGGTVSGVGQYLKSQNPNVKIYGVEPTESNVLNGGKPGPHQITGNGVGFKPDILDMDVMERVLEVSSEDSVNMARQLALKEGLLVGISSGANTIAALRLARMPENKGKLIVTVHPSFGERYLSSVLFEELRKEAENMQPVSVD

SEQ ID NO: 30360 - protein, 280 aa, Aquifex aeolicus
MRDIVFIERDPYAPIRHCYTVSKILYQGKSPYQEIQVIESPEFGRMLILDGVVQLDEKYEFLYHEYLAHVPLHAHPNPRNVLIIGGGDGGTLREVLKHDIVERAVLVDIDKEVIEVSKKYLPTLSVGFQDPRAIVVNEDGYKYVQDYENEFDVIIVDSTDPVGFAHVLTTEDFFRHVYKALKEDGIFVAQTESIHYHLEMVSNIQQRLKKVFPIVDLYTSVIPIYAGYWWTFSIASKKYPVRTPAREVKVQTKIYDADMHEYAFLPESFYNKIVNGEYKY

SEQ ID NO: 30361 - protein, 730 aa, Oryza sativa
  misc_feature (222)..(222): Xaa can be any naturally occurring amino acid
  misc_feature (231)..(231): Xaa can be any naturally occurring amino acid
MDASAGSSAPHSHGNPGKQGGGGGGGGGRGKAPAAEIRGEAARDDVFFADDTFPLLPDFPCLSSPSSSTFSSSSSSNSSSAFTTAAGGGCGGEPSEPASAADGFGELADIDQLLDLASLSVPWEAEQPLFPDDVGMMIEDAMSGQPHQADDCTGDGDTKAVMEAAGGGDDAGDACMEGSDAPDDLPAFFMEWLTSNREYISADDLRSIRLRRSTIEAAAARXLGGGRQGTXMQLLKLILTWVQNHHLQKKRPRTAIDDGAASSDPQLPSPGANPGYEFPSGGQEMGSAAATSWMPYQAFTPPAAYGGDAMYPGAAGPFPFQQSCSKSSVVVSSQPFSPPTAAAAGDMHASGGGNMAWPQQFAPFPVSSTSSYTMPSVVPPPFTAGFPGQYSGGHAMCSPRLAGVEPSSTKEARKKRMARQRRLSCLQQQRSQQLNLSQIHISGHPQEPSPRAAHSAPVTPSSAGCRSWGIWPPAAQIIQNPLSNKPNPPPATSKQPKPSPEKPKPKPQAAATAGAESLQRSTASEKRQAKTDKNLRFLLQKVLKQSDVGSLGRIVLPKKEAEVHLPELKTRDGVSIPMEDIGTSQVWNMRYRFWPNNKSRMYLLENTGDFVRSNELQEGDFIVIYSDIKSGKYLIRGVKVRRAAQEQGNSSGAVGKHKHGSPEKPGVSSNTKAAGAEDGTGGDDSAEAAAAAAAGKADGGGCKGKSPHGVRRSRQEAAAAASMSQMAVSI

SEQ ID NO: 30362 - protein, 312 aa, Bacillus halodurans
MENRRIVIITGANSGIGKEAAQRFANEGDHVIMACRNIAFSRKVQHDIIAASGNDHVDLLELDVSSFASIRTFCTTFNSQYKRLDILIHNAAYFNHGEPYRLSPDGIELTFATNVFGPYLLTSLLRDRLKQSEDPRILHAGSNIIKHFFDPKQTFDLDLLQGNHGTKSYSVYKMYCQSKMALMLLTFQMAEVFADDGIKVNALQINGAKMSKRTIQKVKPWWRPIAWGQNLFFPPPSYMADKYFTICTSDKYKQTTGKLFNDKLEIMEPSPTHYPGFFKQMKLLLGSNVYPAYENTNIREKLWALCKELVGE

SEQ ID NO: 30363 - protein, 856 aa, Gloeobacter violaceus
MAVGFSLRVLVVAANGPLVHALEKTLLSGGYDLALRWAAGTASLHQALMSERPEMILAADGPGEIDALLLLRSLTVHNCCELPLVWIGDAPSTPEGGYLNGADLHLLVLTVERALHQAQQRRETGVARAALRRSEQRLDLFFSQSLDGFFFMMLDRPVRWDATVDKERTLDYVFAHQRLTRVNDALLAQYRASGEQLLGRTPADLFAHDLELGRRLWREFFDRGKLHVETDERRFDGSPMWVEGDYSCLYDEQGRITGHFGIQRDVTVRKLAQEALRTSEAALQEQLQRTLLLQRICEQIRSSLESRQIFQATVDQVGQALGVNCVRILVYSPTPKPELHFAAEYLEAGYPPVHHGSVPVAGDPHAQRVLECDRAVCSPDVYADPQLAPVHELCRSVGLKSLLAVRTSYQGKPNGVITVQQRDRFRRWTPEEIALLEAVAAQVGIALNQAKLLEQEKAQSLLLAEQNAALARARQAAEAASRTKNEFLATMSHEIRTPMNGVIGLADVLLADGGLTHRQRDSIETIRASGETLLTIINDILDFSKAESGCIELETKRFDLHALLAGCVDLLRPEATQKHLQLCCTLHGQVPQAVVGDAARLRQILVNLIGNAVKFTTSGAVSVNVTAARPAAEPPQKWELHFAVRDTGIGIPAERMDRLFKPFSQVDASTTRRYGGTGLGLAICKRLAELMDGRIWVESEPGRGSTFSFTIVAAAATDAPAPAPPVEASWSKPLPLRILLAEDNPLNQKVALQLLRRLGYRANVATDGEEVLRALRRQRYDLVLMDVQMPMIDGLEATRRIASEFAAAERPRIIALTAGATLQDEQACLRAGMDGFISKPIRIGELRRALERWGTG

SEQ ID NO: 30364 - protein, 93 aa, Oryza sativa
MDGRVAIATPSISQCDDRATACPVSKPARRRSHSTPSNAAPGPTRAADDVGGAFGMGAVRGSLFHFLKGTYNSPNSECFVGGAQAVRMNAAGG

SEQ ID NO: 30365 - protein, 612 aa, Vigna unguiculata
MPSSASNTWFNATLPSPPFKDLPSTSSPTNLLPLRKTSSSNTITCSLQTLHFPKQYQPTSTSTSTATTTTPTPIKTTTITTTTPPRETNPLSDTNQPLPQKWNFLQKAAATALDLVETALVSHERKHPLPKTADPRVQIAGNFAPVPEHAADQGLPVVGKIPKCIDGVYVRNGANPLYEPVAGHHFFDGDGMVHAVKFTNGAASYACRFTETQRLSQEKSLGRPVFPKAIGELHGHSGIARLLLFYARGLFGLVDGSQGMGVANAGLVYFNNHLLAMSEDDLPYHVRITPNGDLTTVGRYDFNGQLNSTMIAHPKLDPVDGDLHALSYDVIQKPYLKYFRFSPDGVKSPDVEIPLKEPTMMHDFAITENFVVVPDQQVVFKLTEMITGGSPVVYDKNKTSRFGILHKNAKDANAMRWIDAPDCFCFHLWNAWEEPETEEVVVIGSCMTPADSIFNECEESLKSVLSEIRLNLRTGKSTRRPIISDAEQVNLEAGMVNRNKLGRKTQFAYLALAEPWPKVSGFAKVDLLSGEVKKYMYGEEKFGGEPLFLPNGQKEDDGYILAFVHDEKEWKSELQIVNAQNLKLEASIKLPSRVPYGFHGTFIHSKDLRKQA

SEQ ID NO: 30366 - protein, 317 aa, Gloeobacter violaceus
MEQFDFDVVIVGGGPAGCTCALYTARSELKTVILDKNPAAGALAITHKIANYPGVPGEMSGDHLLEVMRDQAVEFGTVYRRAQVYGLDLSEPVKKVYTPEGIFTGRALVLATGAMGRIASIPGEAEYLGRGVSYCATCDGAFYRNREVVVVGLNPEAVEEAQVLTKFASTVHWITPKDPHTLDGHADELLAHPSVKLWEKTRLIRIKGEEAGVTAVEVRHPGESDSQELLAEGVFVYLQGSKPITDFVAGQVEMKPDGGVWVDEMMQTSVPGVWGIGDIRNTPFKQAVVAAGDGCIAAMAIDRFLNSRKAIKPDWAH

SEQ ID NO: 30367 - protein, 318 aa, Oryza sativa
MGTMVGHVAPGAGFILIGMWQLFNHIRLFALRPSSYAAPVWFPVRGVRHLELILVIVGAAISILMELVIGPARHQPFDDDGTIPSNHLHNFEHASISLALLVYAAVTIHMDRARAPMRDAVSQLVAAAAFAQQLLIFHLHSADHMGVEGQFHWLLQTVIAVTLATTVLGIPCPRSFAVSLVRSASLVFQGVWFVVMGVMLWTPALIPKGCFLNLEEGHDVVRCRTDEALHRAKSLVNLQFSWYLTATVVFVVVFYLHLTKLYPEEPRYLPLVKGGGGGGDGDSDGGRFSIGDDEDDLEAAKGGFGHVAGGGNAVEIER

SEQ ID NO: 30368 - protein, 175 aa, Mycoplasma genitalium
MGIKSIVINEQQIEEGCQKAVNWCNAKFNNKKVIVLGILKGCIPFLGKVISKFSFDLQLDFMAVASYHGSHVQKQPPKIVLDMSHDPKDKDILLIEDIVDSGRSIKLVIDLLKTRHAKSITLISLIEKIKPKAFDINIDFSCFKVKDNFLVGFGLDYDGFYRNLPYVGVFEPDNP

SEQ ID NO: 30369 - protein, 553 aa, Aspergillus nidulans
MPSFSQAVELPAWKELQDHHGSVGRNIVLKECFEKDPQRFEKFSRTFQNTVDNNEILFDFSKNFLTEETLALLVKLAKQAGVEELRDQMFAGEPINFTENRAVYHAALRNVSNQPMQVNGKSVVEDVNSVLEHMKEFSEQVRSGEWKGYTGKKINTIINIGIGGSDLGPVMVTEALKPYGHPDLKLHFVSNIDGTHIAEALKDSDPETTLFLIASKTFTTAETTTNANTAKSWFLEHAKDGAHIAKHFVALSTNAEEVAKFGIDTKNMFGFESWVGGRYSVWSAIGLSVALYIGYDNFHQFLAGAHAMDKHFRETPLEQNIPVLGGLLSVWYSDFFGAQTHLVAPFDQYLHRFPAYLQQLSMESNGKAITRTGEYVKYTTGPVLFGEPATNAQHSFFQLLHQGTKLIPADFIMAAESHNPVEGGKHQRMLASNFLAQSEALMVGKTPEQVKAEGAADNLVPHKTFLGNRPTTSILAQKITPAALGALITYYEHLTFTEGAIWNINSFDQWGVELGKVLAKKIQKELETEGEGSGHDSSTSGLLLAFKKKAKLA

SEQ ID NO: 30370 - protein, 855 aa, Sorghum bicolor
MAFSPRSPWSRPKRNDVYSTFVVHGDDDEDDARGSRRGRGPSTRAEEDEEEDPSSLPPLLQRLPKDFGGPSFDEDEDAYSSDPDDASLSATVVFKSGAPASARSPFLDLRRSSPRATDDDPYSTFVVHSTARSGGTSSSPRGSASGTFIRRSGGSSSPHESVSGTFIRRTSTPSSPRDSVSGTFIRRPGSPSSPRGSFSGTFIRHTSGGSSSYESASGGGGGFGSSFWSPAVEQTEELRQPSPLMQQQQQQHSRRKPSVSSAPDSVTREDPSTKYELLHELGKGSYGAVYKARDLRTQELVAVKIISLTEGEEGYEDIRGEIEMLQQCSHPNVVRYFGSYQGEDYLWIVMEYCGGGSVADLIGITEEPLDESQIAYICREALKGLAYLHSIFKVHRDIKGGNILLTEQGEVKLGDFGVAAQLTRTMSKRNTFIGTPHWMAPEVIQESRYDGKVDVWALGVSAIEMAEGMPPRSTVHPMRVIFMISSEPAPMLEDKEKWSLLFHDFIAKCLTKDPRLRPAASEMVKHKFIEKCNSGASKMLAKIKEAKKIRATLAVQNELSDPDNTMQDVPVRINEDYGETVPTNSQQHMNHGTYNDCQAGDFGTMIVHTEDGDEVAESPIFPRTEFIPGLGSINSFTHDPKRAELISSFWAENTGDSDANKDRDLDDRPDIQESKAIPPLTGTVKKHIGAEGTIRRHDNQVNLSPGFANTTKLNSSPSRKAFSVQDKLWSIYAAGNTVPIPFLKAIDISPLALVSENEAGNGLAGSSTNDALEAVRELFSGDGQAKKGRKGQNEVPLPPGVHHRLMTSPTLMNLAQALAYHKTCYEDMPLQDSQATQEQQTIQNLCDTLRTILRL

SEQ ID NO: 30371 - protein, 255 aa, Triticum aestivum
RLVPEEAIPEVSTYLCESFGNKARIDYGTGHEANFMAWLLCLEKLNVLEQKDDTVVVLRIFVKYIRVMRHLQFEYWLEPAGSHGVWGLDDYHFLPFLFGSSQLLDHKYIKPKSIHDKDVVDQFHQSYMYLACIHFINSVKTTASLRWHSPMLDDISACKTWAKVNQGMIKMYKAEVLAKLPIMQHFMFGSLISFDGGQVMSAELDSHCGHVHNTDNQETENEQEYPECCGIPVPSAIAAAAVSKNTSIFRPLPFD

SEQ ID NO: 30372 - protein, 713 aa, Cryptococcus neoformans
MALPETIRVSPDSPRAHWKSRPALSRAWESGLKAGPIRCRRAFRDPSPLSVVIVDHCGYSRLRCPTSYICLQNISFQLSTTHPTTSATTTMSDNEQVAFFTYILERLKQCGVKQIFGVPGDFNLTALDYIEKDPELQWVGNANELNAAYASDGYARVKGTLAVVITTFGVGELSALCGIAGCLSERVPVLHIVGAPSTSLQAKQSLLHHTLNLPESFSTFSSMSAPLSCSQALINNIEPKTPTSWTEAFDKTLKAVLEQCRPGYVEVPTDAVHAKVSAEGLKQPLPPPHSAPPPESMGTSLSNTSASAASRGAAQVSLSTAPTNVPSAPSSDDVTAHVVEDITKRFGEAKKPIILVDACAGRFGMAIEVRKLVDACGIRFFETPMGKSLMDERHPLYGGCYAGANSLPTVQKEVESADFVLYVGALKSDFNSGSFSVNIDPKVIVELHSFTTTIGYASYPTTDIRTILPLLRPAFEKLGRGKQSEGQSVEQKVEDKSVDSPVVPDPKGDEIKHEWLWPRVGKWFQDTDIIITETGTSSFGLTNVVLPSNSTYIAQILWGAIGWSVGACLGAAMAAKENGNNRRTVLFVGDGSLQLTLQEIGTMLRRGVHPYIFVLNNDGYEIERQIHGWTAEYNDIQLYDHQLLLPFLAGKKTKTPYQSYAVHTPQEFSKLLDDEEFNKPDRLRLIEVFMPRGDAPAGLIRQAKLTAEANDRI

SEQ ID NO: 30373 - protein, 353 aa, Brassica napus
MQTFSQLGPSEIFFIARRDNPCTSNCRAQLWFTGKLHFRQESFGFRLKNRVEYSARPVPPNLIAAEKEEAKAVLTLFFKKQGLSNSVSVRIINKSDLFIDHLVSRLHSVHKARYLVGRELTTLEIRDSLIPYLEQLHEQHGDLLSDLVVSFPDPPPPHAEDRPLSSSSPPATLAPPRGLTDSAADSKKLRAVSRVSELDTEGALRPQTLYLLDLGLNLEQIKTITRKFAAFPYYSLEGKIKPVVEFLLDLGIPKSDIPTILCKRPQICGISLTDNLKPTMAFLETLGIDKNQWAKIIYRFPAILTYSRQKLISTVDFLTQTGLSEEQIGKILTRCPNIMSYSVEDKLRPTMEY

SEQ ID NO: 30374 - protein, 346 aa, Glycine max
MSSSLMLPAASMLRPCTTSSSSCTSSRRLALFHLVSTGSIALPQAQLFGAKGPELLRVVEASAAEKLAQPEKDLFDWVKNDNRRFLHVVYRVGDLEKTIKFYTECLGMKLLRQRDIPEDRYSNAFLGYGPEDSNFTVELTYNYGVDNYDIGSGFGHFGVAVEDIYKRVDLVKAKGGKVTREPGPVKDGSAVIAFIEDPDGYKFELLERRPTSEPLCQVMLRVGDLDRAIAFYEKAVGMKLLRKRDNPEQKYTVAFMGYGPEDKNTVLELTYNYGVTNYDKGNGYAQIAIGTNDVYKTAEAIKLCGGKIILEPGPLPGINTKIVACLDPDGWKLAFVDNVDFLKELE

SEQ ID NO: 30375 - protein, 451 aa, Herminiimonas arsenicoxydans
MTNDIKKTGRIVRAPENFVDPVLAHDITTKGLSEERRGFLRKSFLAAGAAMAGGVPLARAAMPDGDPNILNLPEHSITLGQPVVTNGYGVPSKYETNLLRRESPGLTRVGAASVSFAPLQGLFGIITPSGLHFERHHQGWHDIDPSKHRFMINGLVKNPKVYTMDDLMRLPSVSRMHFIECGANTAMEWGNVAVPTVQYSHGMLSCCEFTGVPLSVLLEDCGYDKKNGKFVLAEGADGSSMTRTISMDRALDDVIVAWGMNGEMLRPENGYPLRLVVPGVQGVSWVKWLRRIEVGDKPYATKDEAIHYIDAMPDGMYRQYTSIQECKSVITTPSAGQMLLDKGFYNITGLAWSGRGKIKRVDVSVDGGRNWRTARLEGPVNTKCLTRFNINWAWDGAPVVLQSRAIDDTGYVQPKINELREVRGTRSIYHNNAIQSWKVSESGEVSNVQVY

SEQ ID NO: 30376 - protein, 320 aa, Thermoplasma volcanium
MEFNLRSVSTEAKERDFDVIIIGAGAAGFSAAVYASRSGLSAVILDKNVAGGLTAEAPLVENYLGFKSIVGSDLAKNFAEHASEYASIREGVEVKSVKKGDGGFIVDTSDGEYHSKYIIITTGTTHKHLGVKGEAEYFGKGVSYCSTCDGYLFKNKNVVTIGGGNSGAIAAISMSEYVKNATIVEYMPRYMCENAYIEEIKKRKIPYIMNAQVTEIVGDGKKVTGVKYKDRSSGEEKTLPADGVFVYVGLIPQTSFLKDSGVKLDERGYIIVDGRQRTNVPGIYAAGDVTSGSFAQIASAVGDGCKAALSLYSDTISSKK

SEQ ID NO: 30377 - protein, 440 aa, Ostreococcus tauri
MHRRDRIHRRPRSSDARASVRRGRDGRVDGVIPLESIVDRIVTALVTMVGVLSAQRWLGGTAVRANDRARARRAGARRGIAPEARIYENILETVGDTPVIKINRLAPEGVEMYVKAEYFNPLSSVKDRLAVAVITDAERRGLLKPGDTVVEATSGNTGIAVAMACAQRGYRCVICMAEPFSVERRKIMRMLGAKVIVTPKAGKGTGMVAKAEELAAKHGWFLCRQFENEANPAYHASTTGPEIVRDFAGKKLDYFVTGYGTGGTFQGVSRVLRESRPDTKIVLLEPEAAALVSSGIKTERKDTGAPAGSHPAFAAHPVQGWTPDFIPLVLENGLNMNLYDELVKIEGGDAVQTAQALARNEGIFTGISGGATFAGALTVAKKAPKGSVILAMLPDTSERYMSTPLYETIDAEMNDEELEIAKSTPSFQLIPGQDPTLLVQ

SEQ ID NO: 30378 - protein, 467 aa, Oryza sativa
MAAAGASALRPHLALLPAGGGGGGGGGTRSYALQALSFVSPLLPHCGRRRRCVLRSKASSSPSPPPSPGKEAVAVPTAESCVNLGLELFSKGRGMVKLNPKIFDHILMSILSLNIRLGLNEHLGLEQVGPGINSIVKDALEQFENALELNPNPVEAQAALYNKACCHAFREESNKAADCLRTALRDYNLKFGTILNDPDLAPFRASPEFKELQEEALRGGEDIGSGFRRDLKLISEVQAPFRGVRRFFYVALTAAAGISTFFTIPRLILAVQGGDGAPDLLETVGNAAINIGGIVVLVALYFWENKKEEQQITQISRNETLSRLPVRLSTNRIIELVQLRDITRPVILAGSKASITRAMQRAERYRTELLKRGVLLIPVIFGASQKAQTKSRLKAEERFKADIVSPEQWESWIRDQQESEGVTPGEDVYIILRLDGRVRRSGRGMPNWNDILQELPRLEELLSKLER

SEQ ID NO: 30379 - protein, 251 aa, Dichelobacter nodosus
SSMASVCGSSLALMDAGVPVQTPVAGIAMGLIKEGDEFAILTDILGDEDHLGDMDFKVAGSATGVTALQMDIKINGITEEIMRQALSQAHEGRLHILEVMNQAIAGTARELSDYAPRFSSMRIDTEKIKDVIGKGGATIRSITEQTGTTIEIEDDGSVKIAATDKAAAANARRLIEEIVAEPEIGRIYDAKVTKITDFGAFLQFLPGKEGLVHISQIADYRVNDVRDELTEGQEVKVKLWKSMPRAGSTFN

SEQ ID NO: 30380 - protein, 261 aa, Unknown
  Nocardioides sp. JS614
MPPVTPAPRLRITLVQHASGLEPEANRRLLGELTPAGSDLVVFPEAFARDFGDAGSDVSAYAESLDGPFATEVARVAADRGTTVVAGLFEAGEDPTRPFNTLVLRGAAEASYRKVHLYDSFGYRESDRLTAGPTGPAVVVEVGGFRVGLMTCYDLRFPELARTLVDAGAQLLVVPSAWVAGPRKVDHWRTLVRARAIENTVFVAAVGQPGPRYTGHSMVVDPLGDVLVEAGDEAAVVTATVDLEALAAARRTNPSLANRRL

SEQ ID NO: 30381 - protein, 717 aa, Saccharomyces cerevisiae
MEQTQTAEGTDLLIGDEKTNDLPFVQLFLEEIGCTQYLDSFIQCNLVTEEEIKYLDKDILIALGVNKIGDRLKILRKSKSFQRDKRIEQVNRLKNLMEKVSSLSTATLSMNSELIPEKHCVIFILNDGSAKKVNVNGCFNADSIKKRLIRRLPHELLATNSNGEVTKMVQDYDVFVLDYTKNVLHLLYDVELVTICHANDRVEKNRLIFVSKDQTPSDKAISTSKKLYLRTLSALSQVGPSSSNLLAQNKGISHNNAEGKLRIDNTEKDRIRQIFNQRPPSEFISTNLAGYFPHTDMKRLQKTMRESFRHSARLSIAQRRPLSAESNNIGDILLKHSNAVDMALLQGLDQTRLSSKLDTTKIPKLAHKRPEDNDAISNQLELLSVESGEEEDHDFFGEDSDIVSLPTKIATPKNWLKGACIGSGSFGSVYLGMNAHTGELMAVKQVEIKNNNIGVPTDNNKQANSDENNEQEEQQEKIEDVGAVSHPKTNQNIHRKMVDALQHEMNLLKELHHENIVTYYGASQEGGNLNIFLEYVPGGSVSSMLNNYGPFEESLITNFTRQILIGVAYLHKKNIIHRDIKGANILIDIKGCVKITDFGISKKLSPLNKKQNKRASLQGSVFWMSPEVVKQTATTAKADIWSTGCVVIEMFTGKHPFPDFSQMQAIFKIGTNTTPEIPSWATSEGKNFLRKAFELDYQYRPSALELLQHPWLDAHII

SEQ ID NO: 30382 - protein, 332 aa, Corynebacterium glutamicum
MVSVSVMGAGSWGTTLAKVFSDAGNAVTLWARREELASTIRDSHENRDYLPGITLPESLQVTSSATEALEGAAIVVLAIPSQALRGNLAEWKETIPQDATLVSLAKGIEKGTHLRMSEVIAEVTEADPSRIAVLSGPNLAREIAEGQPAATVIACPDENRAKLVQAAVAAPYFRPYTNTDVVGTEIGGACKNVIALACGISHGYGLGENTNASLITRGLAEIARLGATLGADAKTFSGLAGMGDLVATCSSPLSRNRSFGERLGQGESLEKAREATNGQVAEGVISSQSIFDLATKLGVEMPITQAVYGVCHRDMKVTDMIVALMGRSKKAE

SEQ ID NO: 30383 - protein, 451 aa, Neisseria meningitidis
MSEYTPQTAKQGLPALAKSTIWMLSFGFLGVQTAFTLQSSQMSRIFQTLGADPHNLGWFFILPPLAGMLVQPIVGHYSDRTWKPRLGGRRLPYLFYGTLIAVIVMILMPNSGSFGFGYASLAALSFGALMIALLDVSSNMAMQPFKMMVGDMVNEEQKSYAYGIQSFLANTGAVVAAILPFVFAYIGLANTAEKGVVPQTVVVAFYVGAALLIITSAFTIFKVKEYDPETYARYHGIDVAANQEKANWFELLKTAPKAFWTVTLVQFFCWFAFQYMWTYSAGAIAENVWHTTDASSVGYQEAGNWYGVLAAVQSVAAVICSFVLAKVPNKYHKAGYFGCLALGALGFFSVFFIGNQYALVLSYTLIGIAWAGIITYPLTIVTNALSGKHMGTYLGLFNGSICMPQIVASLLSFVLFPMMGGLQATMFLVGGVVLLLGAFSVFLIKETHGGV

SEQ ID NO: 30384 - protein, 448 aa, Corynebacterium diphtheriae
MSPIDEKVQGYYELLLKRNPAEPEFHQAVNEVLDSLKIVLEKDPHYADYGLIQRLCEPERQLMFRVPWVDDNGVVQVNRGFRVQFNSAIGPYKGGLRFHPSVNLGIIKFLGFEQIFKNSLTGLPIGGGKGGSDFDPKGKSDVEIMRFCQSFMTELYRHIGEYRDVPAGDIGVGGREIGYLFGQYRRLANQHESGVLTGKGLTWGGSLVRTEATGYGLVYFTAEMLAHHGQSFEGKKVIVSGSGNVAIYAIEKAQELGATVIGFSDSSAWVETPNGVDVAKLKEIKEVRRERVSSYVDEVEGAILHTEGSIWDLTCDVALPCATQNELDGEHAKKLADNGCAFVAEGANMPSTADAIEVYRERGIHFGPGKAANAGGVATSALEMQQNASRDSWSFEYADQRLREIMKGIFKNCESTAREYGHEGDYVVGANIAGFKKVADAMLAQGVI

SEQ ID NO: 30385 - protein, 405 aa, Fusobacterium nucleatum
MHNVRKITEDLYWIGANDRRLALFENIHPIPEGVSYNSYMLLDKETVVFDTVDWSVTRQYIENIEYLLNGRELDYLVVHHMEPDHCGSIEELALRYPKMKIISSEKGFMFMRQFGYKSINGHQLIEAKEGDKFKFGKHEIVFLEAPMVHWPEVLVSFDTTNGALFSADAFGSFKSLDGRLFNDEVNWDRDWLDEGRRYLTNIVGKYGPHIQHLLKKAGPIVDKIKFICPLHGVVWRNDFGYLIDKYDKWSRYEPEEKGILIAYASMYGNTENAVEILAAKLAEKGITNIKMFDVSNTHVSYLISNVFKYSHIVIASPTYNLGIYPVIHNFVMDMKALNLQNRTVAIVENGSWARKSGDLLQEFFETQIKDITVLNERVGLTSSANNVNLDEMDTLVDALVESLNK

SEQ ID NO: 30386 - protein, 980 aa, Idiomarina baltica
MLINATQLEELRVALVDGQRLYDLDIESPGHEQKKANIYKGKITRIEPSLEAAFVDYGAERHGFLPLKEIAKTYFPDGYTFNGRPNIKDVVREGQEVIVQIDKEERGQKGAALTTFISLAGSYLVLMPNNPRAGGISRRIEGEERSALKEALSEINVPKEMGLIVRTAGVGKSKEELEWDLNVLIHHWTAISEAAQKRPAPFLIHQESNVIFRALRDYLRRDIGEVLIDSKKVFEQVRDHIQLIRPDFVNRVKLYEGDVPLFSHYQIESQIESAFQREVRLPSGGSIVIDPTEALTSIDINSARATKGGDIEETAFQTNLEAAEEIARQLRLRDVGGLVVIDFIDMTPTRHQREVENRLRDSLAHDRARIQVARISRFGLLEMSRQRLRPSLGESANAICPRCSGQGTIRSSESLALSILRLIEEEAIKDNTVQVQAQVPVSVATFLLNEKRASVIKIEERHNVKAVIIPNHHMDTPHFEVVRIRDDEVPEAASFNQVQKPEQQEESVAITLTKERQQLEEPALKGLQAPTAPPAPTPQSQPKTKAGSVSLLKRISQWLSQLFGTDEVEEKQQPKPRNNNNQRRGRNNNQRRNNRNNGRRNNNRSANNRDSDKPNTSTDSKPQDKSKTENERSNSEGRANSNRRNRRGRNRNRNQHQNASANKTSETVTNQAEEQAVEKSKGETQDKRESQPKKRREPRKLERSVRVKGDQTENPTAKKDVAKSAEPEQSKAKPAKQKQKVQQTEVVEQPKEVTASNEAKPQVESAPTDDVIKQKVMDPRMQAAAEIVKQAADSNDKAPQQDPQETPKEATNSAQQESTNVATGSESELPEEPVAADVNEPARDIEADTTAESETSPTAATEHASAPAASPTTEQAPKERNRSRRSPRHMRAAGQRRKQEREMSQQSKSVTTPVIPSTITGGKAFAQMTKASAQPRNSEFSALSTASAETRMPFAKSERVASFASATHSAHAVMTKCTSN

SEQ ID NO: 30387 - protein, 385 aa, Unknown
  Populus tremula x Populus tremuloides
MAIDCIKTMPSITTPHHHPKDQDQCKDDGKSFVFDAQVLRHQTNIPQQFIWPDNEKPNINAPELQVPLVDLGDFLSGNPVAAVEASRLVGEACKKHGFFLVVNHGVDKTLIAHAHNYVDTFFKLPLSEKQKAQRKIGESCGYASSFTGRFSSKLPWKETLSFRYKAEENSSKHIEEYFHNRMGEDFAEFGTVYQDYCEAMSTLSLGIMELLGMSLGVSREHFREFFNENDSIMRLNYYPPCQKPDLTLGTGPHCDPTSLTILHQDQVGGLQVFVDNEWRSINPNFDAFVVNIGDTFMALSNGIYKSCLHRAVVNSQTPRKSLAFFLCPKNDKMVTPPHELVDTCNPRIYPDFTWPMLLEFTQKHYRADMKTLEVFTNWLHQRSFS

SEQ ID NO: 30388 - protein, 311 aa, Idiomarina baltica
FDRERTRVSLGLKQLGEDPWADIANRYPEGTRLTGRVTNLTDYGCFVEIEEGVEGLVHVSEMDWTNKNVHPSKVVNLDDTVEVMVLEIDEERRRISLGLKQCKPNPWEEFAKNHNKGDKVSGKIKSITDFGIFIGLEGGIDGLVHLSDISWNATGEEAVRDYKKGEEVTAVVMQVDAERERISLGIKQLEEDPFNNFLAANKKGSIVNGTITEVDAKGAKVELADSVEGYIRAADISRERVEDASTELSVGDSVEARFMGVDRKNRTLSLSIRAKDEVEEKEAVEQVNKQQESSGINSAMADAFKAAKTDD

SEQ ID NO: 30389 - protein, 356 aa, Triticum aestivum
MALLTDLLNLDLTDSTEKIIAEYIWIGGSGMDLRSKARTLPGPVTDPSKLPKWNYDGSSTGQAPGEDSEVILYPQAIFKDPFRKGNNILVMCDCYTPAGVPIPTNKRYNAVKIFSNPDVAKEEPWYGIEQEYTLLQKDINWPLGWPVGGFPGPQGPYYCSIGADKSFGRDIVDSHYKACLFAGVNISGINGEVMPGQWEFQVGPTVGISAGDQVWVARYLLERITEIAGVVVTFDPKPIPGDWNGAGAHTNYSTESMRKDGGFKVIVDAVEKLKLKHKEHIAAYGEGNERRLTGKHETADINTFSWGVANRGASVRVGRETEQNGKGYFEDRRPASNMDPYVVTSMIAETTILWKP

SEQ ID NO: 30390 - protein, 223 aa, Corynebacterium efficiens
MEGNVTMAFFFRPEPKMVTPEEALKGGRHPVLESPQPHTVLGTPITGPWKEGQKRVWIGLGCFWGVEQMYWKMDGVESTSVGYAGGYTPNPTYREVCSGRTGHTEIVEVVYDPEKITLAELVARGLEAHDPTQGYRQGNDVGTQYRSAFYVETGEEAETVRQIVSTYGETLKSHGFGEITTEVDVITPADYYLAEDYHQQYLHKNPDGYCPHHSTGIPCGVEA

SEQ ID NO: 30391 - protein, 149 aa, Pseudomonas fluorescens
MSGLEQATFGAGCFWGAEAAFRALPGVVDSRVGYAVEAADEALQIEVVQVDFDPQVLAYTRLIEHFWDLHDPTSVDRQGEHGGVKYRSAIFHTNAAQAEQARAAKTALQDSGRLNKPVATVIVPLGRFDLADEAHQRYLEKNGLSSCHI

SEQ ID NO: 30392 - protein, 542 aa, Unknown
  Citrus x paradisi
MDQAISSVVRKLQMVNTSDHNSVVSINIFVALPCASIVIGHLLEESRWMNESITALLIGVCAGVIILLTTGGKSSHLFVFSEDLFFIYVLPPIIFNAGFQVKKKQFFRNFITIMLFGAIGTLVSCTIISLGVIQFFKKLDIGTLDIGDYLAIGAIFAATDSVCTLQVLNQDDTPLLYSLVFGEGVVNDATSVVLFNAIQSFDLTHINTRSAFQFIGNFLYLFFTSTLLGVIGGLLSAYVIKKLYFGRHSTDREVAIMVLMAYLSYMLAELFYLSGILTVFFCGIVMSHYTWHNVTESSRVTTKHTFATLSFVAEIFTFLYVGMDALDIEKWRFVKGSPGTSVAASAMLMGLIMAGRAAFVFPLSFLTNLAKKSPTEKISIKQQVIIWWAGLMRGAVSMALAYNQFTRSGHTQLRENAIMITSTITVVLFSTVVFGLMTEPLIRLLLPHPKHTTNHILSDPSTPKSLSQPLLEEGQQDSYADLVGPTVPRPGSLRALLTTPTHTVHYYWRKFDDAFMRPVFGGRGFAPFVPGSPTERSVRGGQ

SEQ ID NO: 30393 - protein, 513 aa, Zea mays
MATTAASSLLKSSFAGSRLPSATRTTTPSSVAVATPRAGGGPIRASISSSPTPPYDLTSFRFSPIKESIVSREMTRRYMTDMITHADTDVVIVGAGSAGLSCAYELSKDPTVSVAIVEQSVSPGGGAWLGGQLFSAMVVRRPAHLFLDELGVGYDEAEDYVVVKHAALFTSTVMSRLPSATRTTTPSSVAVATPRAGGGPIRASISSSPTPPYDLTSFRFSPIKESIVSREMTRRYMTDMITHADTDVVIVGAGSAGLSCAYELSKDPSVSVAIVEQSVSPGGGAWLGGQLFSAMVVRRPAHLFLDELGVGYDEAEDYVVVKHAALFTSTVMSRLLARPNVKLFNAVAVEDLIVRRGRVGGVVTNWALVSMNHDTQSCMDPNVMEAKVVVSSCGHDGPFGATGVKRLQDIGMISAVPGMKALDMNAAEDEIVRLTREVVPGMIVTGMEVAEIDGAPRMGPTFGAMMISGQKAAHLALKALGRPNAVDGTIPEVSPALREEFVIASKDDEVVDA

SEQ ID NO: 30394 - protein, 326 aa, Pseudomonas fluorescens
MVEVRHSRVIILGSGPAGYTAEDFNWSRKQGFRVVQAEECWHKSLEPLMAEVREVDNWPGDVHGLTGPALMERMREHAERFETEIVFDHINAVDFAAKPYTLTGDSATYTCDALIIATGASARYLGLPSEEAFMGKGVSACATCDGFFYRNKPVAVVGGGNTAVEEALYLANIASTVTLIHRRETFRAEKILIDKLNARVAEGKIILKLNANLDEVLGDNMGVTGARLKNNDGSFDELKVDGVFIAIGHTPNTSLFEGQLTLKDGYLVVQGGRDGNATATSVEGIFAAGDVADHVYRQAITSAGAGCMAALDTERYLDGLQNASEW

SEQ ID NO: 30395 - protein, 315 aa, Exiguobacterium sibiricum
MAKAIFAGGCFWCMVKPFHKYDGVEQVISGYTGGHTENPTYKEVCSETTGHLEAVEVTYDPSVITYDELLEIFWRQIDPTDGGGQFNDRGQSYEPAIFYVDEDQKQAAERSKAALDASGRFSKPVAVDIRPAKPFWPAEEYHQDYYKKNPFRYQMYSVGSGRAKFVKEAWKDQGKEQELKQRLTPIQYKVTQENGTEPAFRNEYWDEERPGLYVDIVDGTPLFTSKDKFNSNCGWPSFAKPISEDKMEVELDTSHGMTRTEVRSANADSHLGHIFDDGPTELGGLRYCINSAALRFIPVEELDSAGYGEYKKHFE

SEQ ID NO: 30396 - protein, 543 aa, Exiguobacterium sibiricum
MTCGELSFTTVEWGASFYYVAFSSSFWKVRALFVFSKSVLSKNLNKREANEMNTLQPQRKLDSTEEGLKRGLQARHMSMIAIGGAIGTGLFIASGASVAAAGPGGALLSYAIVGLMVYFLMTSLGEMAAYMPVAGSFSTYGAKFVDPSFGFALGWNYWYNWAVTIAVELVAAQIVMSYWFPDVPGFYFSALFLLLMIGLNYFSVKGFGEAEYWFAMIKVVTVIIFLIVGVAMIFGVFTSEAPVGFKNFALGDAPFVGGIPAVIGIILVAGFSFQGTELVGIAAGESEDPKKNVPKAVKQVFWRILLFYVFAIFVIGMLIPYTSPNLVSNDITDVAVSPFTLVFEKAGLAFSAALMNAVILTSVLSAGNSGMYASTRMLYTLARQGDAPKLFAQVSKNGVPRNALLATGAIGALCFLTSMFGGQVYLWLLNASGMTGFIAWLGIAISHYRFRKGFLAQGHSLSDLPYVAPAFPFGPLFAFGLCFLVIVGQNYAAFLADQIDWVGIAATYVGIPLFLAFWLGHKFKNRTSVVPYEEMEFPEHPRP

SEQ ID NO: 30397 - protein, 447 aa, Unknown
  Acidovorax sp. JS42
MKHQSVGHFLEQVAQRNPGQPEYLQAVTEVMESLWPFIEKNPRYAEQGLLERLVEPERVVMFRVSWFDDHGNVHINRGYRIQHSMAIGPYKGGLRFHPSVNLSVLKFLAFEQTFKNALTTLPMGGGKGGSDFDPKGKSPAEVMRFCQAFVTELFRHVGPDTDVPAGDIGVGGREVGFMAGMYKKLANNAASVFTGKGLAFGGSLIRPEATGYGTVYFADEMLKTRGRSFDGLRVSVSGSGNVAQYAVEKAMQLGAKVITVSDSSGTIIDEDGFTPEKLAILMDVKNHHYGRVSDYAARTGVKFEAGVRPWHVKVDVALPCATQNELDENDARTLIKNGVLCVAEGANMPSTNEAAKLFEQAGVLYAPGKASNAGGVATSGLEMSQNAMRLSWTRDEVDARLLQIMQGIHAACLQYGKRADGSVSYINGANVAGFVKVAEAMLAQGVV

SEQ ID NO: 30398 - protein, 154 aa, Prunus avium
GMQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGTPPDQQRLIFAGKQLEDGRTLADYNIQEESTLHLVLRLRGGF

SEQ ID NO: 30399 - protein, 240 aa, Oryza sativa
MAAEGELKLLGTWASPYVSRVKLALHLKGLSYEYVVEEDHFNNKSELLLSSNPVHKKVPVMIHNGKPICESLIIMEYLDEAFPDTAAPLLPADLHDRAVARFWAAYIDDKLVPSWKQAFSGKTGEEKAEGMRHMLAAVDALEAAMEWSYKGKPFFGGDAVGFLDVALGGLLSWLHGTEELCGAKILDAAKTPLLSAWARRFGEMDAAKVALPDVCKLVEFAKMKRVQLEAAMAATTVSRN

SEQ ID NO: 30400 - protein, 720 aa, Xanthomonas campestris
MATRKFTQRSRIREGRPNPLGATWDGLGVNFALYSRNATRVELCLFDERGREQERIPLPEYTDEVWHGYLPDARPGQLYGYRVHGPYAPDAGHRFNHNKLLLDPYAKQIVGELKWAPHLFGYTIGHRDKDLSFDRRDSAAFMPKSAVIDPAFTWGQDRPPQTPWNRTVIYEAHVRGLSMLHPAVPPENRGTFSALKTDELIDHISSLGVTAVELLPVHAFVDDQYLLEKGLRNYWGYNTLGFFAPQGRYMSTRTVAEFKQMVARLHHAGLEVLLDVVYNHTAEGNELGPTLSFKGIDNASYYRLADDRRFYINDTGTGNTFDLTNVGALRMVMDSLRYWVQEMHVDGFRFDLASILGRERYGFDPSGSFLDAVRQDPVLSQTKLIAEPWDIGPGGYQVGNFPPGWVEWNDKFRDNVRAFWRGDGGQLAELATRLTGSADLFNHSGRRPTASVNFVTAHDGFTLRDLVSYEGKHNLANGEDGRDGSDHNISANYGAEGETDNPAIKQLRRQQMRNLLATLLLSQGTPMLLAGDEFGHSQNGNNNAYCQDNELTWIDWTAATKAAAADQAAFVRRLIRIRQRYPLLHRARFFDGKFDEALGLKDLTWLAPNGNEMDEAAWHDPEARALMLRLDGRSPTTGLREIAANVTLLMLINAAPTSVAFTLPAMHDEHWRVLVDTARHGGRVVAGGSEWKAPAHSLTLLAVERDRIASSARIVSEGAR

SEQ ID NO: 30401 - protein, 171 aa, Thermotoga maritima
MMIKVLIDEETLKKRIKELAREIEEYYLGKTDTIHAVCILKGSIHFFSDLMLNIRKLNVKYSFIHVSSYQGTSSTGKIRVKSWIDESIHDEYVLLVEDIVDTGLTLQHIVRYLKKYNPRDFRIVSLIEKTVHDHGIPLDFVGFRVDDKFLVGYGLDIDEKYRNLPYIGYVE

SEQ ID NO: 30402 - protein, 609 aa, Oryza sativa
MEDDQILVEPDLAAELEQSLVDPTHELEQNLVEQGLVIGQEFVDVHACRRAVKDMAIAMHFELRVVKSDRSRFIAKCAREGCPWRVHVAKCHGVPTFTVRTLHGEHTCDGVRDLHHHQATVGWVARSVEATLRDNPQYKPKEILQDIREQHGVAVSYMQAWRGKERSMAAVHGTLEDGYRFLPAYCEQIVQTNPGSVAIYKGTGPDNSFQRLFVSFHASIHGFLNACRPLLEIDKADLKGKYLGTLLCASAVDAENMMFPLAFGIVDAESDENWMWFFSELRKMLGVNTDKMPVLTILSERQSQVVEAVEVNFPTAFHGFCLRYVSENFRDEFKNPKLLNIFWSAVYALTAAEFDSKVNDMVQVQDVMPWFQRFPPNLWAVSYFEGIRYGHFNLGITEILYNWAMECHEFPIVQTVEHIKHQLTCWFVERQNLALSYNSILVPSAEKLISEAIADSGCYQVLRANKVEFEIVSSERTNIVDTQARCCSCRRWQIYGIPCAHAVAALLSCGEDPRLYAHECFSIMKYRETYSQPIYSIPDRSQWNLPFSFAQGAGSKAYAVLRPPKIRRPPGRPKMKILKIESLKRPKRIVQCGRCHLLGHSQKKCSLRN

SEQ ID NO: 30403 - protein, 476 aa, Unknown
  Silicibacter sp. TM1040
MSNLKEPSFRESVDLMFNRAVALMDLPPGLEEKIRVCNATYTVRFGVRLRGQIHTFTGYRSVHSEHMEPVKGGIRYAMGVNQDEVEALAALMTYKCALVEAPFGGSKGGLRIDPRQYDEHELELITRRFAYELAKRDLINPSQNVPAPDMGTGEREMAWMADQYARMNTTDINARACVTGKPLNAGGIAGRVEATGRGVQYALQEFFRYEEDKAKAGLSGTLDGKRVIVQGLGNVGYHAAKFLSEEDGCKIVAVIERDGGLYDENGLDIEDLRAWIEKHDGVDGYPSGRYIKNGAKYLEEDCDILIPAALEGVINLSNAENVKAKLIIEAANGPVTAGADEILRKKGTVIIPDMYANAGGVTVSYFEWVKNLSHIRFGRMQRRQEEARHQLVVDQLEMLSESMGKTWSLDPKFKEKYLRGAGELELVRSGLDDTMRIAYQSMRQVWHERDDVSDLRTAAYLVSIDKVASSYRAKGL

SEQ ID NO: 30404 - protein, 477 aa, Magnaporthe grisea
MVDAPKDLVKEIKDLEEMFTVDTAKLKQITNHFVGELERGLSVEGGDIPMNPTWVMSFPDGYETGTFLALDMGGTNLRVCEITLTDQKSEFDIIQSKYRMPEELKTGQSDELWDYIADCLLQFIETHHGDPKKIEKLPLGFTFSYPATQNYVDEGILQRWTKGFDIAGVEGKNVAPMLMKALSERGVPVKLVALINDTTGTLIASAYTDTQMRIGCIFGTGCNAAYMEECGSIPKLAHMNLPPETPMAINCEWGAFDNQHKVLPRTPYDVKIDEDSPRPGQQAFEKMIAGLYLGEIFRLILVDLHDNHEVRIFKNQDISKLRRAYTLDSSFLSAIEDDPWENLSETLDLFQDKLNLVPNRNELELIRRTAELIGTRAARLSACGVAAICKKKNYRSCHVGADGSVFNKYPNFKQRGAQALREILDWPAKEDPKEEDPIEILAAEDGSGVGAALIAALTLKRAKEGNFHGISNPENFK

SEQ ID NO: 30405 - protein, 719 aa, Bordetella bronchiseptica
MFNKVTKTFQYGQHSVVLETGEMARQASGAVLVSVEDTVVLATVVAAKKAKAGQDFFPLTVDYIEKTYAAGRIPGGFFKREGKPSEKETLTSRLIDRPLRPLFPEGFYNDVQVVIHTLSVNPDIDPDIPAMIGASAALAISGIPFNGPIGAARVGYVDGQYVLNPTATQLKSSKMDLVVAGTENAVLMVESEAKQLSEEIMLGGVVFGHEQMQTAINAIHDLVRDAGKPDWDWQPAPKNEALIAAVSAAAQEGLNAAYQIREKQARTTKLREVYAAVQAAMAEQAAQAGQPAPDSVGVDNILFDLEARIVRSQILNGEPRIDGRDTRTVRPISIRLGVLPRAHGSALFTRGETQALVVATLGTKQDEQIIDALMGEYRDRFMLHYNMPPFATGETGRIGVPKRREIGHGRLAKRALLPLLPAPEDFQYTIRLVSEITESNGSSSMASVCGGSLAMMDAGVPTNDHVAGVAMGLILDSGKFAVLTDILGDEDHLGDMDFKVAGTETGITALQMDIKIQGITKEIMQVALAQAREGRLHILGKMRDALEGSRTELSAFAPRMLTIKINPEKIRDVIGKGGATIRALTEETGTQIDISDDGTIVIASVDETQAKEAQRRIVELTADVEVGQIYDGSVLRLLDFGAIVQVLPGRDGLLHISEIANYRIANINDVLKVGQPVRVKVIEADDKGRLRLSIKAIGGIEQQQSGTAEPAAQSEPQAE

SEQ ID NO: 30406 - protein, 447 aa, Burkholderia mallei
MTSRDERLHRGLEERHINLMALGATIGVGLFLGSATAIRAAGPAILLTYILGGVAIFLIMRALGEMAIDNPVAGAFSRYARDYIGPLAGYLTGWTYWFMWIVTCMAEITAVGVYMHMWFPDVPNWIWTFAALIVMGAVNFIAVKLYGEFEFWFALIKIVTIVLMIAGGALMIVAGVGNGGVPTGVSNLWAYGGFLPNGWPGVVDALPIVMFAYLGVEMLGLTAGEARNPEKSLAKAVNSVFWRVVIFYVGALFVIMSVYPWNQIGTQGSPFVMTFSRLGIPAAAGIINFVVLTAALSSCNSGIFSTARMLFNLAEQGQAPERLASVNRRGVPVHGVLISVALLFVGVVLNYFAPQKVFVWLTSVSTFGAIWTWCVILIAQLRFRRRVSAERLARLPLRVPCYPLSSFVALAFLAFVVVLMAFSPDTRVALVIGPLWIAALTVYYYAS

SEQ ID NO: 30407 - protein, 416 aa, Neisseria meningitidis
MFSKSVTLAQYDPDLAAAIAQEDQRQQDHVELIASENYVSCAVMEAQGSQLTNKYAEGYPGKRYYGGCEYVDIVEQLAIDRVKKLFGAQYANVQPHSGSQANQAVYASVLKPGDTILGMSLAHGGHLTHGASVNISGKLYNAVTYGLDENEVLDYAEVERLALEHKPKMIVAGASAYALQIDWAKFREIADKVGAYLFVDMAHYAGLIAGGEYPNPVPFCDFVTTTTHKTLRGPRGGVILCRDNTHEKALNSSIFPSLQGGPLMHVIAAKAVAFKEALQPEFKQYAKQVKINAAAMAEELVKRGLRIVSGRTESHVFLVDLQPMKITGKAAEAALGKAHITVNKNAIPNDPEKPFVTSGIRIGSAAMTTRGFNEADARVLANLVADVLSNPEDEANLENVRKQITALCDKYPVYGA

SEQ ID NO: 30408 - protein, 296 aa, Saccharophagus degradans
MEYPTIEAIIGNTPLVRLQRLPGCEKNTVLVKLEGNNPGGSVKDRPALSMIQRAEAAGAIKPGDTIIEATSGNTGIALAMVAAVKGYNMILIMPDHMTEERKAAMTAYGAKLILVSKAEGMEGARDLAQAMASRGEGVVLDQFSNTDNPLAHFTGTGPEIWQQTGGTVTHFVSSMGTTGTIVGTSKFLKSQNPNVQVVGLQPAEGAAIPGIRAWPQEYMPTIFTDENIDSVVQMSQQKAEETMRLLAKKEGVFCGVSSGGAVAAALDIAASTEGAVIVAIICDRGDRYLSSGVFNS

SEQ ID NO: 30409 - protein, 448 aa, Clostridium aminovalericum
MKIVVIGCTHAGTAAVKTILKENPEAEITIFERNDNISFLSCGIALYVGGVVKDPAGLFYSNPEELSKMGANVKIKHNVKSIDTKSKKVIAEDMNTGEEIEVSYDKLVNTTGSWPIIPPIPGIESKNILLCKNYDQANVIIRQTKDAKKIVIVGGGYIGIELVEAFQKSGKQVTLIDGLDRILNKYLDKEFTDILEDDLKKNGINLALDQCVKSFKANENGEVTSVETTKGEYEADMVILCVGFRPNNELLKGKVDMLPNDAIIVDEYMRTSDPDIFAAGDSCAVHYNPNGNYAYIPLATNAVRMGMLIGKNISTPKVKYRGTQSTSGLNLFGYNIGSTGVTVSGAPQIGLNVRSVIVKDNYRPEFMPTNEEIIMQLVYEVGTNRIVGGQVMSKYDITQSANTLSLAIQNKMTIEDLAYVDFFFQPHFDRPWNYLNILGLAALEQEGL

SEQ ID NO: 30410 - protein, 410 aa, Campylobacter jejuni
MRNLLENIKKNSQKLLNLTPKDKEKIILKLAQILRENFKIILEANKKDMANFTKSGAMKDRLLLDEKRILALCEGLEKIAYIEDPIGKISKGWKNYAGLNIQKISIPLGLICVIYEARPSLSAEIAALMIKSSNACVFKGGSEAKFTNEAIFTLVNKVLKEFDLQDCFAMFTQRDEILQILAFDDLIDVIIPRGSSNMIQEIANNTKIPLIKQNKGLCHAFVDQSANLDMALKIILNAKCQRVSVCNALETLLIHEKIAKNFISLLIPEFEKFKVKIHAHENTLAYFNNSNLEIFKANENTFDTEWLDFALSVKLVKDCDEAIEHINKHSSLHSETIISNDASNIAKFQRLINSSCIYANASTRFSDGGEFGFGGEVGISTSKLHARGPMGIEDICTYKYIINREGQIRE

SEQ ID NO: 30411 - protein, 80 aa, Aquifex aeolicus
MGKKKRKQEHEKERGILLEGEVVEALPNGMFRVKLETGQEVLAHIAGKLRVNFIRILPGDKVKVELSPYDLTRGRIVYRL

SEQ ID NO: 30412 - protein, 774 aa, Methanosarcina barkeri
MLGELYTDHKQNLKEYHYIIERGYPHPLGATPDENGVNFSIYSEHADYVELLLFDKCDDLNPALILYTNRVGELTHSENIENSVKVSEDIENIESSVKVSEDIENIESSVKVSENSETTEATSIALNKTFHFWHVYVRGLKPGVHYAYRIGGPFDPSRGCRFDGDKVLIDPYSKGNNKTLWNREKACMPGDNLAFSMRSVVIDMSHYKWGNNSHVTAEKIYEMPGMGEKLYGKKRLQELNETIIYELHVGGFTRSPTSGATASGTFSGVIDKIPYLKELGITAVELMPVFDFDDATSLDGRKQYWGYDPICFFAPHSGYCVNPEYGAHMEEFRDMVRALHKAGIEVVLDVVFNHTAEGDNLGPVFSFKGIDNSIYYLLEPDEQYYSNYSGCGNTVSCNHPISQKLIVDCLKYWAKEMHVDGFRFDEGSILSLDTNGKVMKYPPVIWQIELDDALGYIKVIAEAWDAAALNQVGYFPGPRWAEWNGYYRDEIRRFVRGDPGIVRRVASRIAGSPDLYQSESRLPINSVNFVTCHDGFTLNDLVSYNHKHNEANGENNRDGIENNLSWNCGVEGETEDPEVETLRERQIKNFAAILLLSIGVPMICMGDEVRRTQKGNNNAYCQDNETSWFDWDLVEKNHDMFRFWKLMIDFRKRHTTILRPRYFTGKENERGLKDISWHGCKLYSPGWDDPHARALSFTMGEPGDEEDIHVLMNMYWEPLEFEIPELKGISRSWYRAVDTFLPSPQEIAGAGEETQVNGNSYIVQGRSVVVLISK

SEQ ID NO: 30413 - protein, 480 aa, Leifsonia xyli
MTTATTDKAPKQVAVNDIGSAEDFLAAVEKTLKFFNDGDLIEGTVVKIDRDEVLLDVGYKTEGVIPSRELSIKHDIDPSEVVDVGDTVEALVLQKEDKEGRLILSKKRAQYERAWGDVEKIKDADGVVTGTVIEVVKGGLIVDIGLRGFLPASLIELRRVRDLTPYLGQEIEAKILELDKNRNNVVLSRRALLEQTQSESRTTFLNNLYKGQVRKGVVSSIVNFGAFVDLGGVDGLVHVSELSWKHIEHASEVVEVGQEVTVEILEVDLDRERVSLSLKATQEDPWQVFARTHAIGQVAPGKVTKLVPFGAFVRVADGIEGLVHISELSGKHVELAEQVVSVGEEVFVKVIDIDLERRRISLSLKQANEGVDPEGTEFDPALYGMVTEYDEQGNYKYPEGFDAETNEWKDGFDTQREEWEQQYAAAQARWEAHKRQVAKGLEETSVDAGSASYSSETGAGGTLADDESLAALREKLSSSN

SEQ ID NO: 30414 - protein, 234 aa, Zea mays
MAGREADKDPELKVLGVWSSPFVIRARVALNLKGLAYRYVEDNLDSKSELLLASNHVHGKVPVLLHDGRPVCESWVIVEYIDEAFPASGPCLLPADPYRRAVDRFWASYVDDKLFPTWIPVYNGRTSEDRVAAARQVVAVLEKFERAFDECSGGKAFFGGDAAGLVDVVLGGFLGWLRASEVMCGVRVIDPAKTPLLAAWADRFAALDGVREVIPDVQRLLEYNKIRRARRGLP

SEQ ID NO: 30415 - protein, 100 aa, Nicotiana tabacum
MDMALPVSAIGFEGFEKRLEISFFEPGLFADPNGKGLRSLSKAQLDEILGPAECTIVDSLSNDDVDSYVLSESSLFVYSYKIIIKTCGTTKLLLAIPPIL

SEQ ID NO: 30416 - protein, 98 aa, Nicotiana tabacum
SYASFEAVGYDMKTMKLGPLVERVLACFEPDEFSIALHAHVATKLLQRVCSVDVKGYSLAECSPEEFGKGGSIVYQKFTRTPFCGSPKSVLKGCWKEE

SEQ ID NO: 30417 - protein, 325 aa, Staphylococcus aureus
MSVEEYGKVYLIGAGPGNPNYLTKKAERLIREADVILYDRLVNPLILQYANLTTEIIDVGKKPYAKHIQQEKINDCIVEAARRYNKVVRLKGGDPAIFGRVQEEVDTLNEHHIAFEIVPGVTSASAAVATMQTGLTMRTVAKSVTFSTGHFKDSEENEVDVNSLVNGGTLAIYMGVKRLGKIITQIQQYKDIDYPIAIVFQASCFNEFVVKGRLSNIISKLQHYSIEAKPGICIIGEVVGYTENVSTTSNPTQQFYVVSGSKHDALMLCEHLYDEGYGCLLNPNNTSNGTYHSSQYDYYDAFIKQQENVTYISTDRADANTVLCH

SEQ ID NO: 30418 - protein, 344 aa, Unknown
  Comamonas sp. CNB-1
MLPKVCIIGAGCSGFTTAKALADRGIPFDCFDMSDQIGGNWVFKNKNGRSACYQSLHIDTSKYRMQFEDLPIPSHFPDYPHHSQVLEYFNAYVDRFGLRKRITFNTEVTKAELMPDKTWRVTLSNGETRSYGALVVANGHHWDQYIPSFPGTFDGPSFHSHRYIDPFEPVDMRGKRILVVGMGNSAMDIASELSQKPIAKRLVVAARRGVWIFPKYINGKVPDKGHAFVDAPLPDPRAGEAHDHPCRRAHEGLRASRARASSCGCAPFGVRRVPDAGRMWRCCREAEYRGTARYQGQVRGRFCRNPTYKPSAFSASLKAHMLERASREVNRNGKILDANKTETA

SEQ ID NO: 30419 - protein, 202 aa, Corynebacterium diphtheriae
MATQPRIGSISRVTSESDIRVEINLDGTGTVEIDTGVPFFDHMLTAFGVHGAFDLKVKATGDTHIDAHHTVEDTAIVLGQAIAQAVGDKRGIKRFGSFQLPMDETLCEAIVDFSGRPYFVTKGEPDYLVHSVIGSHYPTVLNEHFFESLALNAKITLHVLCRYGRDPHHITEAEFKAVARAIREAVGPDDRLTGIPSTKGAL

SEQ ID NO: 30420 - protein, 156 aa, Triticum aestivum
MATDPSKYKLNHSMIRIKDPKRSVQFYEFLGMKQINQIKNPDAKFDLYFLAYDSPKAVSHGNHWTDREGIVELTHNYGTEDDPNYKISNGNTEPHKGFGHLCISVDNLQAACQRLEDAGYKFQKKLTDGRMRHIAFVLDPDGYWVEVIGQKPLEET

SEQ ID NO: 30421 - protein, 608 aa, Oryza sativa
MATITTPGYAHIQRQHGRCSTTAGRRGASNSVRFSARAVSSVPHAAAASSAPAFLPVPFVPGADAPSPSGKSAIGVPKAPRKGEEGKRLNFFQRAAAMALDAFEEGFVANVLERPHGLPSTADPAVQIAGNFAPVGETPPARALPVSGRIPPFINGVYARNGANPHFDPVAGHHLFDGDGMVHAVRIRNGAAESYACRFTETARLRQERAMGRPMFPKAIGELHGHSGIARLALFYARAACGLLDPSHGTGVANAGLVYFNGRLLAMSEDDLPYQVRVTADDDLETVGRYDFDGQLGCAMIAHPKLDPATGELHALSYDVIKKPYLKYFYFAPDGTKSADVEIPLDQPTMIHDFAITENYVVVPDHQVVFKLQEMLRGGSPVVLDKEKTSRFGVLPKHAADASEMVWVDVPDCFCFHLWNAWEEADTDEVVVIGSCMTPADSIFNESDDRLESVLTEIRLNTRTGESTRCAILPPSSQVNLEVGMVNRNLLGRKTRYAYLAVAEPWPKVSGFAKVDLATGELTKFEYGEGRFGGEPCFVPMDAAAATPRGEDDGYILSFVHDERAGTSELLVVNAADMRLEATVQLPSRVPYGFHGTFITGDELTTQA

SEQ ID NO: 30422 - protein, 204 aa, Viburnum melanocarpum
  misc_feature (146)..(146): Xaa can be any naturally occurring amino acid
  misc_feature (164)..(164): Xaa can be any naturally occurring amino acid
YKHPVKGRKINWMKAGILESDRVFTVSPYYAEELVSGVDKGVELDNFIRKTGITGIVNGMDTQEWNPATDKYVGVKYDITTVMDAKPLLKEALQAEVGLPVDRNIPLIGFIGRLEEQKGSDILAAAIPKFIEQBVQIVVLGTGKKXMEKQLEQLEILYPDKVRXVAKFNVALAHMIIAGADFMMIPSRFEPCGLIQLHAMRYGT

SEQ ID NO: 30423 - protein, 238 aa, Oryza sativa
MEGGGGGADGQAQPVAQAPPAMQPMQQLSRYESQKRRDWNTFLQYLKNHRPPLTLARCSGAHVIEFLKYLDQFGKTKVHASGCAYYGQPSPPAPCPCPLRQAWGSLDALIGRLRAAYEESGHAPESNPFAARAVRIYLREVRDAQAKARGIPYEKKKRKRTQQQQPPPPPPPPPQHQPGAAAGEASSSSSAAAAAVAAEGSGSSAAAAAATSQTGGGGGGSTTTTTASAAAPTTATRV

SEQ ID NO: 30424 - protein, 204 aa, Viburnum molle
YSKPVKGRKINWMKAGILESDGVFTVSPYYAEELISGIEKGVELDNIIRKTGITGIANGMDTQEWNPATDKYVGVKYDITTVMDAKPLLKEALQAEVGLPVDRNIPLIGFIGRLEEQKGSDILAAAIPKFIEQNVQIVVLGTGKKNMEKQLEQLEILYPDKARGVAKFNVALAHMIIAGADFMLIPSRFEPCGLIQLHAMRYGT

SEQ ID NO: 30425 - protein, 420 aa, Unknown
  Shewanella sp. MR-4
MSNVRYISNLTRETYALILAGGRGSRLHELTDWRAKPALYFGGKFRIIDFPLSNCINSGIRRVGVVTQYKSHSLIRHVMRGWGHFKKELGESVEILPASQRYSENWYQGTADAVFQNIDIIRHELPKYVMVLSGDHVYRMDYAGLLAAHAESGADMTVSCLEVPVAEAAGAFGVMEVDDEMRILGFEEKPKHPKHSPGNPEKCLASMGNYVFNTEFLFDQLKKDAQNANSDRDFGKDIIPSIIEKHKVFAYPFKSAFPNEQAYWRDVGTLDSFWQANMELLSPTPALNLYDAKWPIWTYQEQLPPAKFVFDDDDRRGMAVDSIISGGCIISGATVRRSVLFNEVRVCSYSVVEDSVVLPDVVVLRHCKIKNAIIDRGCIIPEGTVIGYNHDHDRAKGFRVSEKGITLVTRDMLGLPVGYE

SEQ ID NO: 30426 - protein, 204 aa, Viburnum nudum
YNKPVKGRKINWMKAGILESDRVFTVSPYYAEELVSGVDKGVELDNFIRKTGITGIVNGMDTQEWNPSTDKYVGVKYDITTVMDAKPLLKEALQAEVGLPVDRNIPLIGFIGRLEEQKGSDVLAAAIPKFIEQNVQIIVLGTGKKYMEKQLEQLEILYPDKARGVAKFNVALAHMIIAGADFMMIPSRFEPCGLIQLHAMRYGT

SEQ ID NO: 30427 - protein, 204 aa, Viburnum plicatum
YDKPVKGRKINWMKAGILESDRVFTVSPYYAEELVSGVDKGVELDNFIRKTGITGIVNGMDTQEWNPAMDKYVGVNYDITTVMDAKPLSKEALQAELGLPVDRNIPLIGFIGRLEEQKGSDILAAAIPKFIEQNVQIVVLGTGKKYMEKQLEQLEILYPDKARGVAKFNVALAHMIIAGADFMMIPSRFEPCGLIQLHAMRYGT

SEQ ID NO: 30428 - protein, 752 aa, Unknown
  Shewanella sp. MR-4
MTNPVPVNADGSTAYNLSAGQPFPLGATVDDGGVNFALFSAHATGVELCLFDAQGEVETQRIPLTEQTQQIWHLYVHGLSAGQLYGYRVYGPYEPQLGHRFNPHKLLLDPYARQLVGRYHHHIANFGYEIDNPNEDLSFSTLDNADFVPKCKVVDTRPLFDAAKAHTIRPLSSKREPLPLEQCIIYEMHLKGFTALHPEIDAPLRGTFAGLASNAAIDYLVNLGVNCVELLPVQAFFSEPFLLEKQLSNYWGYNSVGFFAPEPSYLSSEDIGEFRTMVDALHGAGIEVILDVVYNHSAEGSRLGPTFSFRGIDNLSYYRLHPNDKRFYINDTGCGNTLNLNHPRMLQLVLDSLRYWVEVMGVDGFRFDLAACLGREAYGFDPGSGFFDALLQDPVLCRVKLIAEPWDIGPGGYQLGNFPVAFSEWNDRYRDTMRRFWRGDHGMLPEFARRFHGSGDFFEHSGRPPAASINFLTSHDGFTLKDLVSYCERHNWANGEENRDGHHENFSHHYGVEGDTDDATILALRARQQRNLLTTLFLSQGVPMLLSGDETGRTQGGNNNAYCQDNPLNWFDWSSDGMDSSLLSFTSQLIALRKRFPLLCSKRFIHEQLVANAFDWSSESSSSHAVSPASTPTGARLDWFSRQGEPMSKSLWSESMGRSLCVVLSGNLTATQPQTQGDNLQALLLMVNADEHPLAFTLPVFDGLGPWQCLLHTQTDPQFLTPTEPLDAQSSPTRYLLQDRSLMLFHADFIRN

SEQ ID NO: 30429 - protein, 319 aa, Thermotoga maritima
MKKIAVLTSGGDAPGMNAAVRAVVRYGVRQGLEVIGVRRGYSGLIDGDFVKLEYKDVAGITEKGGTILRTSRCEEFKTEEGRELAAKQIKKHGIEGLVVIGGEGSLTGAHLLYEEHKIPVVGIPATIDNDIGLTDMCIGVDTCLNTVMDAVQKLKDTASSHERAFIVEVMGRHSGYIALMAGLVTGAEAIIVPEIPVDYSQLADRILEERRRGKINSIIIVAEGAASAYTVARHLEYRIGYETRITILGHVQRGGSPTAFDRRLALSMGVEAVDALLDGEVDVMIALQGNKFVRVPIMEALSTKKTIDKKLYEIAHMLS

SEQ ID NO: 30430 - protein, 914 aa, Cryptococcus neoformans
MSDSPAATPLPKDPEGITEQIQSVSTPPPPPQAQKPARQKKIAVLTSGGDSAGMNAAVRAIVRQSIARGCQAYIIREGWEGLVRGNTSGPTPAPTAPQSPTLSASSKTVTFSSLPPSQQFDKLTSTLNKESLANEVSFSDPNEVTPLEDTPLSFGYGQLLRDGAGEGDVEELASHGMQGLAIADREDEKGRSLKNKYIVRVGWDDVRGWQGEGGTLIGSSRCPAFRTREGRLQAASNLIHSGIDCLAVCGGDGSLTGADKLRGEWPSLVEELYTENKITDDQREAYHHLNIVGLVGSIDNDMALTDLTIGALTALHRICESIDSISSTASSHSRAFVIEVMGRHCGWLALLAGIATGADFIFIPEDPPKCEDWETEMCDLLQAHRKVGKRKSIVIVAEGALDRNLKPIKPDYVKKILVERLGLDTRVTTLGHTQRGGKPCAFDRILPTLQGVEAVQTLLSATPETPSYMIGIQENKITKIPLLEAVARTQMVAEAIENRDFAKAMSFRDSEFREMLQAFQISSSLDVSQNAPVDKRLRIGIIHVGAPAGGMNAATRQAVRFCHNRGHVPVAIYNGFEGLLDDNVSELSWLRVDSWTTRGGSELGTNRSLPSIDIGSVAAGFQRYSLDALLVIGGFEAFHSVVLLSQNRTNYPAFQIPIVHLPATLSNNVPLTDFSLGSDTSLNALVEACDAIKQSASASRNRVFVVETQGGMSGYIATMGALAVGAVLVYTPENGISLKLLQEDVEFLIKRYKLDEKGKSEGRLVIKAEKSSSVYTTETLTKIFKEEGKDLFDARSASLGHTLQGGVPSPLDRTRAARLSLRCMQFLEEHASPNSQASHHKPKSAAHPHAGAKSIAKDTAAMIAIIGSKVVYATMDDVLKVTDMKLRRGTDEWWSDCKELAETMGGRTGLMAKH

SEQ ID NO: 30431 - protein, 437 aa, Thermotoga maritima
MNYPYIPHTDEDVRAMLDFIGVSSIEELFSSIPVSARSSLNIPESRDEFSVFKQLKEISEMNNSLEDYAVFLGAGVYKRYVPTVVYDLAMKPDFLTAYTPYQAEVSQGTLQALFEYQTMVCELTGMEVANASMYDGATALAEAALMSFRLTGKEKVVVARSVHPEYRAVLRTYLEKRGFTVVEAGYDETGRVLLEEVDEETAAIAVQYPNFFGIIEDLDYVRSRSGNALLIVVVEPVSLALLEPPGSYGADIVVGEGQSLGLPMWFGGYSLGIFATREEYVRQMPGRLIGQTVDQAGNTAYTMILQTREQHIRRARATSNICSNHAHAALIAAVYMSVMGPDGLKEVARRSYNAAHYLQERLEEIGFKLCFSGEFFNEFVFNVPEDYPDRWRKMMEKKILGPLPLEEFYPELGDTALACATEVISKEDIEKLLEAMK

SEQ ID NO: 30432 - protein, 400 aa, Zea mays
MTMERSQPQHQQSPPSPSSSSSCVSADTVLVPPGKRRRRAATAKANKRARKDPSDPPPAAGKRSSVYRGVTRHRWTGRFEAHLWDKHCLAALHNKKKGRQVYLGAYDGEEAAARAYDLAALKYWGPEALLNFPVEDYSSEMPEMEAASREEYLASLRRRSSGFSRGVSKYRGVARHHHDGRWEARIGRVLGNKYLYLGTFDKSSVSADTQEEAAKAYDLAAIEYRGANAVTNFDISCYLDHPLFLAQLQQEQPQVVPALDQEPQADQREPETTAQEPVSSQAKTPADDNAEPDDIAEPLITVDNSVEESLWSPCMDYELDTMSRSNFGSSINLSEWFTDADFDSDLGCLFDGRSAVDGGSKGGVGVADFSLFEAGDGQLKDVLSDMEEGIQPPTIISVCN

SEQ ID NO: 30433 - protein, 170 aa, Brassica napus
  misc_feature (16)..(16): Xaa can be any naturally occurring amino acid
  misc_feature (40)..(40): Xaa can be any naturally occurring amino acid
  misc_feature (84)..(84): Xaa can be any naturally occurring amino acid
  misc_feature (98)..(98): Xaa can be any naturally occurring amino acid
  misc_feature (102)..(102): Xaa can be any naturally occurring amino acid
  misc_feature (107)..(107): Xaa can be any naturally occurring amino acid
  misc_feature (129)..(129): Xaa can be any naturally occurring amino acid
  misc_feature (133)..(133): Xaa can be any naturally occurring amino acid
  misc_feature (162)..(162): Xaa can be any naturally occurring amino acid
FEVYRPGLGSKLSPGXSEAVTLAQWISQSYTHNLGSELVXRIASLGSKTLLKLIWNHQDAILCCSLKPQPVFMFANQAGLDMLXTTLVALQDIALEKXFDEXGRKAXCSDFAKLMQQEFACLPSGICLXTMGXHATYEQAVAWKVFAVSDNDNNNNLHCLAXSFVNWSFV

SEQ ID NO: 30434 - protein, 474 aa, Thermotoga maritima
MTIFERSKKGRKAFRLPESDIPEYSLPDRFLRRTPPELPEVSEPDLVRHYTNLARKNYSVDLGIYPLGSCTMKYNPKLNEKAANLEGFREIHPYQPVETVQGSLRLMYELKKMLCEITGMDDMTLQPAAGAHGELTGMLIVREYFKNRGDTGRKKVLVPDSAHGTNPASASMVGFEVVEIKSKNGMVDVEDLKKLLDEEVAAVMLTNPNTLGLFEKDILKIAEMTHECGALLYYDGANLNAIMGKVRPGDMGFDIVHLNLHKTFSTPHGMGGPGSGPVGVKKHLVDFLPFPQVKKNGELYELFVPEKTIGRVRSFFGNFPVLVKAYTYILTMGRDGLERVSEMAVLNANYLKKKIEKFLEIPYNGFCMHEFVASAEKVFRETGVRTLDIAKRILDFGVHPPTVYFPLIVPEALMIEPTETENKETLDKYAEILERVVKEAYENPDALKNAPHNTPVRRVNEVLASKKPVFRWRG

SEQ ID NO: 30435 - protein, 663 aa, Debaryomyces hansenii
MLEGEFQASVKLTYKTSSQTTTDIAGQVNPKLVYDPCDNDIPIAQVYGKMKPTPEILKNSDLLQLVSEWVAKFSKVLEDISESPTSNINELDSIFAPHSFWKDHLCLSWDFHQYSDLGQIKDFLSKQIPYFQLQNFQINRTADLRYDNSISIATIQDSTGEQPIPIQLVQFIVNFDNCYGKGSGVIRLIPVDNKLIAYSVYTGLESIKGNEEQLGFNRPEGVNHGQHKARTSWLENREKDFIWGDSSKQPTVLVVGGGQSGLNIAARLKCMGVDTLIVEKNPNIGDNWRNRYKFLVLHDPVWADHLAYMNFPDTWPIFTPKDKLGDWFENYAKNMELSFWANKTVVGADFEEDKSTWIVKVIDNDSGKMDTLRPKHVIMATGHSGEPNIPSFEDQHKFKGKIVHSSQHSTGKMYQGENALVVGCCNSGHDIAQDFYEQGAKPILVQRSSTCIFTAEVGGEITNEGLYEEGGPPIDTADLLSQSMPWKLLNLTLQQQTRRIVSLEKELHDSLKNVGFNIDYGYGGTGLPGKYSRRGGGYYIDVGCSRLIAERKILVKNGQSIHKFTEDGVVFSDGSTIGNVAIVVLATGYSNMKESARKIFGSTVADRLNPVWGLDDEGETKVMYRDSGHPNFWYMGGNLLLTRYFSKKLALRIIAQERDFIKD

SEQ ID NO: 30436 - protein, 454 aa, Unknown
  Populus sieboldii x Populus grandidentata
DLNHRNLTDLAKKFGDILLLRMGQRNLVVVSSPDLAKEVLHTQGVEFGSRTRNVVFDIFTGKGQDMVFTVYGEHWRKMRRIMTVPFFTNKVVQQYRHGWEEEAAQVVEDVKKNPEAATHGIVLRRRLQLMMYNNMYRIMFDRRFESEEDPLFNKLKALNGERSRLAQSFDYNYGDFIPILRPFLRGYLKICKEVKERRLQLFKDYFVEERKKLGSTKSMSNEGLKCAIDHILDAQKKGEINEDNVLYIVENINVAAIETTLWSIEWGIAELVNHPEIQKKLRDELDTVLGPGHQITEPDTYKLPYLNAVIKETLRLRMAIPLLVPHMNLHDAKLGGFDIPAESKILVNAWWLANNPAKWKNPEEFRPERFFEEEAKVEANGNDFRYLPFGVGRRSCPGIILALPILGITLGRLVQNFELLPPPGQSKIDTSEKGGQFSLHILKHSTIVAKPRSF

SEQ ID NO: 30437 - protein, 415 aa, Unknown
  Burkholderia sp. 383
MFDRAQSTIANVDPEIFAAIEQENRRQEDHIELIASENYTSPAVMAAQGSQLTNKYAEGYPGKRYYGGCEYVDVVEQLAIDRVKQLFGAEAANVQPNSGSQANQGVFFAMLKPGDTIMGMSLAHGGHLTHGSPVNMSGKWFNVVSYGLNENEDIDYEAAEQLAQEHKPKLIVAGASAFSLKIDFERLAKIAKSVGAYLMVDMAHYAGLIAAGVYPNPVPHADFVTTTTHKSLRGPRGGVILMKAEYEKPINSAIFPGIQGGPLMHVIAGKAVAFKEALSPEFKAYQEKVVENARVLAETLVKRGLRIVSGRTESHVMLVDLRAKHITGKAAEAALGAAHITVNKNAIPNDPEKPFVTSGVRLGSPAMTTRGFGPAEAEQVGNLIADVLDNPEDAATIERVRAQVAELTKRFPVYR

SEQ ID NO: 30438 - protein, 168 aa, Avena sterilis
VMASSATSVAPFQGLKSTAGLPVSRRSNAGLGSVSNGGRIRCMQVWPIEGIKKFETLSYLPPLTEEALLKQIDFLIRSKWVPCLEFSQGGFIFREHGSTPGYYDGRYWTMWKLPMFGCTDASQVIKEVEEVKKEYPDAYVRIIGFDNIRQVQCVSFIAFKPPGCEESG

SEQ ID NO: 30439 - protein, 489 aa, Unknown
  Candidatus Kuenenia stuttgartiensis
MKVLLINPPYLKKFSRPQRSPAVTKSGTLYFPLWLAYATGVLEEKGFEVNLVDAPADSLSIDDIIEKTLTFQPNLIVLDTSTPSIDNDVAVARRLKETCPSSFIILVGTHVSALPEEVLNKENSVDAVARNEYDYTLHDLAKILSEKGDLKTVRGISYRNGNEIIHNPGRPYIENLNELPFVSKVYKEFLRIENYFNPNALYPMVTITTSRGCPFPCTFCVYPQTLMGRGFRQRSINNVVEEMEYITKNFPQAKAVFFEDDTLTVNKKRCKELAECIIQKKVNISWTANARVGLDYETMRTMKTAGCRSLCVGFESGSQQVLDNMKKKLSLAEMEAFMANAKKAGMLIHGCFMAGLPGETKETLQETLQLAKRLNPDTAQFYPVMVYPGTEAYTWYKEKRLITTDNFSEWLTPEGLHNTVISTEELSSYDLVRFCDGARRSFYLRPGYLLYKLKQMITHPREIKRTLKSARTFLKYLLRGSDVKPKIQC

SEQ ID NO: 30440 - protein, 420 aa, Neisseria meningitidis
MSNTQKQLALAKAAKKSVNTADTEEKNRALLAMADSLEAAAADILAANRQDLEAAAGKIPESMTDRLLLDGKRICAMADGIRAVAALPDPVGEILETSTLPNGLEIVKKRVAMGVIGIIYESRPNVTSDAAALALKSGSAVVLRSGKDAFQSARAIVAALKTGLAQTRIDPDALQLIEDTGREGSYEMMRAKDYLDLLIPRGGAGLIRAVVENAVVPVIETGTGIVHIYVDKDADLEKAIRIVRNAKTSRPSVCNSMEVLLVHEDIAADFLPKLERLLVRDRIEAGLPPVRFRLDPQAARHIGGEAAGADDFDTEFLDYILAVKTVASVEEAVGHIEAHGTHHSDGIVTENRHAADYFTTHIDSAAVYVNASTRFTDGGEFGLGCEMGISTQKLHARGPMGLKELTSYKYIVQGTGQVRE

SEQ ID NO: 30441 - protein, 369 aa, Neisseria meningitidis
MKYKRIVFKVGTSSITHSDGSLSRGKIQTITRQLAALHHAGHELVLVSSGAVAAGFGALGFKKRPVKIADKQASAAVGQGLLMEEYTANLSSDGIVSAQILLSRADFADKRRYQNAGGALSVLLQRRAVPIINENDTVSVEELKIGDNDTLSAQVAAMIQADLLVLLTDIDGLYTGNPNSNPDAVRLDKIEHINHEIIEMAGGSGSANGTGGMLTKIKAATIAAESGVPVYICSSLKPDALAEAAEHQADGSFFVPRAKGLRTQKQWLAFYSESRGSVYVDEGAEHALSEQGKSLLMSGIAGIEGHFSRMDTVTVYSKATKQPLGKGRVLFGSAAAEDLLKSRKAKGVFIHRDDWISITPEIRLLLTEF

SEQ ID NO: 30442 - protein, 261 aa, Nicotiana tabacum
MEAANHNNDNGCTNESPYISSVLPGWFSEISPLWPGEAHSLKVEKILFQGKSDYQNVMVFQSSTYGKVLVLDGVIQLTERDECAYQEMIAHLPLCSIPNPKKVLVIGGGDGGVLREVSRHSSVEQIDICEIDKMVVEVSKQFFPDVAVGYEDPRVNLHIGDGVAFLKNVAAGTYDAVIVDSSDPIGPAQELFEKPFFDSIARALHPGGVVSTQAESIWLHMHIIEEIVANCRQIFKGSVNYAWTTVPTYPSGMIGFMLCST

SEQ ID NO: 30443 - protein, 436 aa, Unknown
  Marinobacter sp. ELB17
MSNNTNHLLDDAQSRMADIYERLEVADDSRHRLGQPKRIHQASLSVRMDDGSLRVFPAWRVQYDDTRGPTKGGIRFHPNVTEDEVATLSLWMTLKCAAVDLPFGGAKGGICVDPKTLSRLELERLSRGYIRAFHDVIGPDRDIPAPDVNTNAIVMGWMVDEYAQIARRHVPGVITGKPLGLGGSIGREEATGAGALQVLDLWAKRQNKEPHELSVAIQGFGNAGQNFARLAHHAGYKIVALSDSQGAIYNEDGLDPEPILRHKNRTRELKGMVYCGDSVCDAAETETQTLSGDELLQLDVDVLVLAALENQITDANADHIRAKTIVEIANGPISTGGDQILQGRDITVIPDIVANAGGVIVSHLEWVQNRMGDYWSGDTVEKQLRQRLEREANACFDLADEKAVPLRTAAYLQGVRRIVDAMAQQGTQGYFNDRRG

SEQ ID NO: 30444 - protein, 422 aa, Bradyrhizobium japonicum
MSSTTHADDDPVTTTRRRFLTAGSAAVGGAVLGTSTAAAETDNLPPNVPEWMKAPGEPTGGQLYGAPSPFEKGVVKNISKALKQYISASSRTPLQELDGIITPNGLFYERHHGGVPTIDPAQHRLMLHGLVERPLIFTIDDLRRFPSESRIHFLECSGNPGYTKPYGKTASDLVGLVSCAEWTGVSLKLVLQEAGLKPEAKWVVAEGADAAALTRSIPIEKCLEDAMLVYSQNGERLRPQQGYPLRLFLPGFEGNMSVKWLRRLHVTAEPVYSREETSKYTDLLSDGTAREFSFYMEAKSIITRPSGGQRLSAPGFHEVTGIAWSGHGKIARVEVSVDDGRSWQDARLQEPVLTRALTRFRLPWQWDGKPAVIQSRAIDETGYVQPTLAELLAVRGENYFYHNNAIWPWLIAADGEVTNALA

SEQ ID NO: 30445 - protein, 735 aa, Corynebacterium diphtheriae
MNDSPVTSDRQIWPGQSYPLGSKYDGAGTNFAIFSDVAEKVELCLIDAECNEERILLDEVDAHIWHCYLPGVKPGQRYGFRVHGPYNPAEGKRCDPSKLLVDPYARAFDGEFDGHPSLFSYDINDPENPEGRNTEDSLEHTMKSVVVNPFFDWGSDRSPNTPYNETVIYEAHVKGMTMRHPDVPESLRGTYAGLAHPSIIEHLKDLGITAIELMPVHQFLQDDRLRDLGLRNYWGYNTFGFFAPQQDYAAAQEPGGAVSEFKGMVRAFHEAGIEVILDVVYNHTAEGNHMGPTIAFRGIDNEAYYRLVDGDKAHYMDYTGTGNSLNVRDPHPLQMIMDSLRYWVSEMHVDGFRFDLASTLARELHDVDKLATFFDLVQQDPIVSQVKLIAEPWDVGEGGYQVGNFPPLWTEWNGKYRDTVRDFWRGEPSTLGEFASRLTGSSDLYANNGRRPTASINFITAHDGFTLNDLVSYNHKHNDANGEDGRDGESHNRSWNCGEEGPTEDPRINKLRARQRRNFLTTLLLSQGTPMIAHGDEMARTQDGNNNVYCQDNETSWMDWELADKNAALMEFTKRLITIRRNHPVFRRRRFLAGGPLGSEVGDRDIAWLVPSGKLMGQSDWDFAFGKSLMVYFNGKAIQEPDARGQRIEGDSFIMMFNAYHEPIDFTLPDTEFGPAWKLIVDTNVDTGYPDEAKTLRAGDSITVEARSTLILRLVDTTHKSQTVEKDRRDDDYSD

SEQ ID NO: 30446 - protein, 204 aa, Viburnum rafinesquianum
YSKPVKGRKINWMKAGILESDGVFTVSPYYAEELISGVEKGVELDNIIRKTGITGIANGMDTQEWNPATDKYVGVKYDITTVMDAKPLLKEALQAEVGLPVDRNIPLIGFIGRLEEQKGSDILAAAIPKFIEQNVQIVVLGTGKKNMEKQLEQLEILYPDKARGVAKFNVALAHMIIAGADFMLIPSRFEPCGLIQLHAMRYGT

SEQ ID NO: 30447 - protein, 421 aa, Thermococcus kodakarensis
MVEIDPFEMAVQQLERAAQFMDISEEALEWLKRPMRIVEVSVPVEMDDGSVKVFTGFRVQHNWARGPTKGGIRWHPAETLSTVKALATWMTWKVAVVDLPYGGGKGGIIVDPKKLSEREQERLARSYIRAVYDVIGPWTDIPAPDVYTNPKIMAWMMDEYETIMRRKGPAFGVITGKPPGVGGIVARMDATARGAAFTIREAAKALGWDDLKGKTIAIQGYGNAGYYLHKIMSEEFGMKVVAVSDSKGGIYNPDGLPPADEVLKWKKEHGSVKDMPGTQNITNEELLELEVDILAPSAIEGVITKENADNVKAKIVAEVANGPVTPEADEILHEKGILQIPDFLCNAGGVTVSYFEWVQNINGFYWTVEETRKRLDDKMTKAFWDVFNTHKEKNIHMRDAAYVVAVSRVYEAMKHRGWVKK

SEQ ID NO: 30448 - protein, 357 aa, Vibrio fischeri
MSKQQKILFIDRDGTLIVEPPVDFQVDRLDKLKFEPLVIPSLLSLQDAGYRLVMVTNQDGLGTDSYPQDEFDAPHNMMMEFFESQGVKFDDVLICPHFEEDNCSCRKPKLGMVKEYLQGGRVDFQHSVVIGDRQTDLQLAENMAIRGIQYHPETMNWPAILKDLTVNARTAEVIRTTKETDIKVFVNLDEQGGNEITTGLGFFDHMLDQIATHGGFQMKINVEGDLHIDDHHTIEDTALALGEALKEALGDKRGIGRFGFSLPMDECLAQCALDLSGRPYLKFDAEFSREQVGDLSTEMVVHFFRSLTDTLACTLHLSSSGYNDHHIIESLFKAFGRTLRQAIKVEGNELPSSKGVL

SEQ ID NO: 30449 - protein, 136 aa, Unknown
  Shewanella sp. MR-4
MSQLLHTMLRVGNLERSIAFYTQVLGMKLLRTSKNPEYKYSLAFVGYGEESTGQAVIELTYNWGTEKYDLGTAFGHIAIGDEDIYARCEAIAAAGGKVTRAPGPVAGGTTEIAFVEDPDGYKIEFIQMKSATQGLG

SEQ ID NO: 30450 - protein, 204 aa, Viburnum opulus
YSKPVSGRKINWMKAGILESDKVFTVSPYYAEELVSGVEKGVELDNFIRKTGITGIVNGMDTQEWNPATDKFVAVKYDITTVMDAKPLLKEALQAEVGLPVDRNIPLIGFIGRLEEQKGSDILAAAIPKFIEQNVQIVVLGTGKRYMEKQLEQLEILYPDKARGVAKFNVALAHMIIAGADFMMIPSRFEPCGLIQLHAMRYGT

SEQ ID NO: 30451 - protein, 334 aa, Mycobacterium smegmatis
MAIDDFPRYPLTFGPSPIHPLERLTKHLGGAQIWAKREDVNSGLAYGGNKTRKLEYLIPDALAQGADTLVSIGGVQSNHTRQVAAVAAKLGMKAVLVQEKWVDWPDSVNDKVGNILLSRVMGADVRLDASGFGIEFKDSWRNAIEDVKNAGGTPYAIPAGASDHPLGGLGFANWAYEVQRQEQELGVFFDTIVVCTVTGSTHAGMIAGFAGQNRPRRVIGIDASATIDKTREQVTRIARNTADRIGLGRDLHDDEITVLEGWAGELYGIPVQSTIDAIKLTGRLEGVILDPVYEGKSMAGLIDLVRSGEIPPSSTVLYAHLGGQPALNAYSGIF

SEQ ID NO: 30452 - protein, 585 aa, Thermoactinomyces vulgaris
MLLEAIFHEAKGSYAYPISETQLRVRLRAKKGDVVRCEVLYADRYASPEEELAHALAGKAGSDERFDYFEALLECSTKRVKYVFLLTGPQGEAVYFGETGFSAERSKAGVFQYAYIHRSEVFTTPEWAKEAVIYQIFPERFANGDPSNDPPGTEQWAKDARPRHDSFYGGDLKGVIDRLPYLEELGVTALYFTPIFASPSHHKYDTADYLAIDPQFGDLPTFRRLVDEAHRRGIKIILDAVFNHAGDQFFAFRDVLQKGEQSRYKDWFFIEDFPVSKTSRTNYETAAVQVPAMPKLRTENPEVKEYLFDVARFWMEQGIDGWRLDVANEVDHAFWREFRRLVKSLNPDALIVGEIWHDASGWLMGDQFDSVMNYLFRESVIRFFATGEIHAERFDAELTRARMLYPEQAAQGLWNLLDSHDTERFLTSCGGNEAKFRLAVLFQMTYLGTPLIYYGDEIGMAGATDPDCRRPMIWEEKEQNRGLFEFYKELIRLRHRLASLTRGNVRSWHADKQANLYAFVRTVQDQHVGVVLNNRGEKQTVLLQVPESGGKTWLDCLTGEEVHGKQGQLKLTLRPYQGMILWNGR

SEQ ID NO: 30453 - protein, 204 aa, Viburnum suspensum
YNKPVKGRKINWMKAGILESDRVFTVSPYYAEELISGVDKGVELDNFIRKTGITGIVNGMDTQEWNPAMDKYVGVNYDITTVMDAKPLLKEALQAEVGLPVDRNIPLIGFIGRLEEQKGSDILAAAIPKFIEQNVQIVVLGTGKKYMEKQLEQLEILYPDKARGVAKFNVALAHMIIAGADFMMIPSRFEPCGLIQLHAMRYGT

SEQ ID NO: 30454 - protein, 136 aa, Aeromonas hydrophila
MNEFLKTLLNIRSLRAALRELSFEQLQEVKEKFDQIYTEYFESTEKERAEQAEHQRKLAEFSEMLKQAGVDPRDLISGSTPAASTKTSSKVKRAPRPAKYKYQEDGQEKTWTGQGRMPKAIAEQIEQGKHLEQFKI

SEQ ID NO: 30455 - protein, 585 aa, Thermoactinomyces vulgaris
MLLEAIFHEAKGSYAYPISETQLRVRLRAKKGDVVRCEVLYADRYASPEEELAHALAGKAGSDERFDYFEALLECSTKRVKYVFLLTGPQGEAVYFGETGFSAERSKAGVFQYAYIHRSEVFTTPEWAKEAVIYQIFPERFANGDPSNDPPGTEQWAKDARPRHDSFYGGDLKGVIDRLPYLEELGVTALYFTPIFASPSHHKYDTADYLAIDPQFGDLPTFRRLVDEAHRRGIKIILDAVFNHAGDQFFAFRDVLQKGEQSRYKDWFFIEDFPVSKTSRTNYETYAVQVPAMPKLRTENPEVKEYLFDVARFWMEQGIDGWRLDVANEVDHAFWREFRRLVKSLNPDALIVGEIWHDASGWLMGDQFDSVMNYLFRESVIRFFATGEIHAERFDAELTRARMLYPEQAAQGLWNLLDSHDTERFLTSCGGNEAKFRLAVLFQMTYLGTPLIYYGDEIGMAGATDPDCRRPMIWEEKEQNRGLFEFYKELIRLRHRLASLTRGNVRSWHADKQANLYAFVRTVQDQHVGVVLNNRGEKQTVLLQVPESGGKTWLDCLTGEEVHGKQGQLKLTLRPYQGMILWNGR

SEQ ID NO: 30456 - protein, 249 aa, Tubocapsicum anomalum
  misc_feature (154)..(154): Xaa can be any naturally occurring amino acid
  misc_feature (219)..(219): Xaa can be any naturally occurring amino acid
GTIVCGKGMNLIFVGTEVGPWSKTGGLGDVLGGLPPALAARGHRVMTISPRYDQYKDSWDTSITVEVKVGDSIETVRFFHCYKRGVDRVFVDHPMFLEKVWGKTGSKIYGPKAGQDYLDNELRFSLLCQAALEAPRVLNLNCSKYFSGPYGEDXLFIANDWHTALIPCYLKSMYQSRGIYVNAKVAFCIHNIAYQGRFAFSDFSLLHLPDEYRSSFDFXDGYEKPVKGRKINWMKAGILESHRVVTVSP

SEQ ID NO: 30457 - protein, 204 aa, Viburnum tinus
YNKPVKGRKINWMKAGIIESDRVFTVSPYYAEELVSGVDKGVELDNIIRKTGITGIVNGMDTQEWNPAMDKYVGVKYDITTVMDAKPLLKEALQAEVGLPVDRNIPLIGFIGRLEEQKGSDILAAAIPKFIEQNVQIVVLGTGKKYMEKQLEQLEILYPDKARGVAKFNVALAHMIIAGADFMMIPSRFEPCGLIQLHAMRYGT

SEQ ID NO: 30458 - protein, 441 aa, Burkholderia mallei
MSDKATRIELLDWRTVPMRAFHLTWIAFFVCFFAWFACAPLMPLIAREFRLSADQVANVNIAAVAATIAVRLVVGPLCDRFGPRRVYAGLLACGAIPVFAVTLSHDYLTFLLCRLGIGAIGASFVITQYHTSVMFAPNVVGTANAAAAGWGNAGAGAAQAAMPLVVAAALLLGLPDACAWRAALAVPGAAMLVMAIVYWRGTQDCPQGDFVALRARGVTIDSGKKGGFASFAAACGNYRVWMLFVTYGACFGVEVFMHNIAALYYVNHFALSLKDAGLAAGIFGLLALFARALGGWLSDRVAARRGLDVRATLLFALILGEGLGLLWFAHAGSVPVALVAMVAFGLFTHMACGATYALVPFIDRRALGGVAGIIGAGGNAGAVAAGFLMKGVGDIQQTLTLLGLFVTVSAFCALAVRFSSEHKAREAALRERALAASGFTH

SEQ ID NO: 30459 - protein, 161 aa, Arabidopsis thaliana
NIFFFFIKSHKSSTLNHKSQSFGYQMARTKQTARKSTGGKAPRKQLATKAARKSAPATGGVKKPHRFRPGTVALREIRKYQKSTELLIRKLPFQRLVREIAQDFKTDLRFQSSAVAALQEAAEAYLVGLFEDTNLCAIHAKRVTIMPKDIQLARRIRGERA

SEQ ID NO: 30460 - protein, 136 aa, Arabidopsis thaliana
MASSMLSSATMVASPAQATMVAPFNGLKSSAAFPATRKANNDITSITSNGGRVNCMQVWPPIGKKKFETLSYLPDLTDSELAKEVDYLIRNKWIPCVEFDTDLCTVSTVTHPDTMMDGTGQCGSFPCSVAPTPLKC

SEQ ID NO: 30461 - protein, 274 aa, Burkholderia mallei
MNTMGKVTLLGAGPGDLDLLTMKAAKALAAADVLLLDDLVDPGIVALAPRARVIRVGKRGGCRSTPQAFIERLMCRYALRGAHVVRVKGGDVLLFGRAGEELAALRAARVPVEIVNGISSGFAAAASLGVSLTHRDHCQGVTFVTAHLQDHGEPDWASLAATGTTLAIYMGMSRIERIAAGLLSTLDDKTPAAVVQWAGAPAERRWTGTLGHLASGAAEAGLGSPAVIFVGRAIGEALAIGDAHAAPHANAHALADDAHAALHAAERRRISHAA

SEQ ID NO: 30462 - protein, 312 aa, Thermotoga maritima
MRIDLSLKPTPVQFLKRLSEKYGFNIYVKRDDLTELVGSGNKIRKLEYLLWEALKKGATTVFTCGGLQSNHARATAYVSRRYGLKPVLFLRKGEKVLNGNLLLDILLGAEIVEVSPEEYERIDEIFDVHKKMREKKGEKVYVIPEGGSNSLGAFGYFNAVLEMKDQLNLESFDAIVCAVGSGGTIAGLSAGISFLEYHVPVVGVNVTTKNSDYFVGKVKRIISGMEEYGLRVNETVFEVVDDYRGPGYAIPSSEDVEILKEVASIEGIILDPVYTAKAFRGMIEMFRNSEKNVLFIHTGGIFGLFAQSRRLV

SEQ ID NO: 30463 - protein, 447 aa, Salmonella enterica
MDQTCSLESFLNHVQKRDPHQTEFAQAVREVMTTLWPFLEQNPRYRHMSLLERLVEPERVIQFRVVWLDDKNQVQVNRAWRVQFNSAIGPYKGGMRFHPSVNLSILKFLGFEQTFKNALTTLPMGGGKGGSDFDPKGKSEGEVMRFCQALMTELYRHLGPDTDVPAGDIGVGGREVGFMAGMMRKLSNNSACVFTGKGLSFGGSLIRPEATGYGLVYFTEAMLKRHGLGFEGMRVAVSGSGNVAQYAIEKAMAFGARVVTASDSSGTVVDESGFTPEKLARLCEIKASRDGRVADYAREFGLTYLEGQQPWSVPVDIALPCATQNELDVDAARVLIANGVKAVAEGANMPTTIEATDLFLEAGVLFAPGKAANAGGVATSGLEMAQNAARLSWKAEKVDARLHHIMLDIHHACVKYGGDNKHTNYVQGANIAGFVKVADAMLAQGVI

SEQ ID NO: 30464 - protein, 187 aa, Arabidopsis thaliana
MENNNGNNQLPPKGNEQLKSFWSKEMEGNLDFKNHDLPITRIKKIMKYDPDVTMIASEAPILLSKACEMFIMDLTMRSWLHAQESKRVTLQKSNVDAAVAQTVIFDFLLDDDIEVKRESVAAAADPVAMPPIDDGELPPGMVIGTPVCCSLGIHQPQPQMQAWPGAWTSVSGEEEEARGKKGGDDGN

SEQ ID NO: 30465 - protein, 523 aa, Mycobacterium tuberculosis
MTSTRQAGEATEASVRWRAVLLAAVAACAACGLVYELALLTLAASLNGGGIVATSLIVAGYIAALGAGALLIKPLLAHAAIAFIAVEAVLGIIGGLSAAALYAAFAFLDELDGSTLVLAVGTALIGGLVGAEVPLLMTLLQRGRVAGAADAGRTLANLNAADYLGALVGGLAWPFLLLPQLGMIRGAAVTGIVNLAAAGVVSIFLLRHVVSGRQLVTALCALAAALGLIATLLVHSHDIETTGRQQLYADPIIAYRHSAYQEIVVTRRGDDLRLYLDGGLQFCTRDEYRYTESLVYPAVSDGARSVLVLGGGDGLAARELLRQPGIEQIVQVELDPAVIELARTTLRDVNAGSLDNPRVHVVIDDAMSWLRGAAVPPAGFDAVIVDLRDPDTPVLGRLYSTEFYALAARALAPGGLMVVQAGSPYSTPTAFWRIISTIRSAGYAVTPYHVHVPTFGDWGFALARLTDIAPTPAVPSTAPALRFLDQQVLEAATVFSGDIRPRTLDPSTLDNPHIVEDMRHGWD

SEQ ID NO: 30466 - protein, 563 aa, Xylella fastidiosa
MCSIFGIFNLQPSDNLQILRHQALECSQRQRHRGPDWSGVYVDVGAILVHERLAIVDPAGGAQPLLSEDGTLALAVNGEIYNHAVLKGTLQQPYAFQTHSDCEVINALYREETPTSFLNRLNGIFAFVLWDKTTGRGLIARDPMGVVPLYWGHDQDGRLRVASEMKALVEHCSDVAQFPPGHWYDTTTGTLVKYYERPWKNYSAVEGVQVSLQELREAFERAVHRQLMTDVPYGVLLSGGLDSSLVAAVAARYARHRIETNDQSEAWWPRLHSFAIGLKDSPDLSAANVAAEALNTVHHRFEYTFQEGLDVLPEVIRHIETYDVTTIRASTPMFLLARRIKAMGVKMVLSGEGSDEIFGGYLYFHKAPNAREFHEELVRKLNALYYYDCLRANKAMMAWGVEPRVPFLDREFLDVAMRMDAQHKMVDKTSNGPQRMEKGILRAAFDGYLPPSILWRQKEQFSDGVGYGWIDGLKAHAETQVSDHALATAETRFQVNPPQTKEAYYYRSIFERFFPSPAAAETVPGGKSIACSSPAAIAWDASFATMADPSGRAVSGVHQQALL

SEQ ID NO: 30467 - protein, 458 aa, Unknown
  Candidatus Kuenenia stuttgartiensis
MLNMKILLVQSYLKGDVFPPVYPLGISYIASFLTKHEVRIYDPNLSLNPIDDLIKEINGFSPQIIGISLRNIDNQSRKNPLNYYGDFQHLLRTIKKRCPSTHIVAGGTGFSMFAQEIMNTNPEIDYGVYLEGEETLSELTDNLDHPDKVKGVYYRKNGVVYYTGTRTLPQFEKFPAPGRDIVNPIPYINGEAAIGIQTQRGCPLKCAYCNYPALNGNLLRSRPPANVVDEIENLLHSYGIQQFMFADSLFNKPLEHAIGICKEIMKRNLQDEIKWMCWLDVRGVTKDFLHLLKNAGCSGISFSPDGLSTSSLISLRKGIKERDVWNILKIITTDPVIKDTKFIITMFINSPGETYFGMIKMLFYKFLSLAAKKILKRNVNVQIGWIRLEPDTEIYRVAMKQGIISPGKSLLPANANDVKTLFYLNPSLQFLDRIVLAMASVTESIKGKIKHTLIRRAL

SEQ ID NO: 30468 - protein, 378 aa, Bordetella bronchiseptica
MTAQTSAVSVISAANRLVAKVGSSLVTNEGRGLDRAAVGHWAAQIAALHQQGKQVVLVSSGAIAEGMARLGWRKRPSAMHELQAAAAVGQMGLCQAYEAAFAEFGLRTAQILLTHEDLADRHRYLNARSTLFALLRLGVVPIVNENDTVVTDEIRFGDNDTLGALVTNLIEADALIILTDQRGLYEADPRRDPAARFVAHAQAGDAALEAMAGGAGSGVGTGGMLTKILAAKRAAHSGAHTVIASGRERNVLTRLAQGECIGTELRAVLPVWSARKQWLADHLRLRGRVVLDDGAVHALLHEGKSLLPIGVAEVQGEFERGDVVACVDMHGRECARGLINYSSADTRRILRQPSSQIARILGSMTDPELMHRDNLVVT

SEQ ID NO: 30469 - DNA, 1832 bp, Oryza sativa
cctctgttttgtttttcaccctcaatatttggaaacatttatctaggttgtttgtgtccaggcctataaatcatacatgatgttgtcgtattggatgtgaatgtggtggcgtgttcagtgccttggatttgagtttgatgagagttgcttctgggtcaccactcaccattatcgatgctcctcttcagcataaggtaaaagtcttccctgtttacgttattttacccactatggttgcttgggttggttttttcctgattgcttatgccatggaaagtcatttgatatgttgaacttgaattaactgtagaattgtatacatgttccatttgtgttgtacttccttcttttctattagtagcctcagatgagtgtgaaaaaaacagattatataacttgccctataaatcatttgaaaaaaatattgtacagtgagaaattgatatatagtgaatttttaagagcatgttttcctaaagaagtatatattttctatgtacaaaggccattgaagtaattgtagatacaggataatgtagactttttggacttacactgctacctttaagtaacaatcatgagcaatagtgttgcaatgatatttaggctgcattcgtttactctcttgatttccatgagcacgcttcccaaactgttaaactctgtgttttttgccaaaaaaaaatgtataggaaagttgcttttaaaaaatcatatcaatccattttttaagttatagctaatacttaattaatcatgcgctaataagtcactctgtttttcgtactagagagattgttttgaaccagcactcaagaacacagccttaacccagccaaataatgctacaacctaccagtccacacctcttgtaaagcatttgttgcatggaaaagctaagatgacagcaacctgttcaggaaaacaactgacaaggtcatagggagagggagcttttggaaaggtgccgtgcagttcaaacaattagttagcagtagggtgttggtttttgctcacagcaataagaagttaatcatggtgtaggcaacccaaataaaacaccaaaatatgcacaaggcagtttgttgtattctgtagtacagacaaaactaaaagtaatgaaagaagatgtggtgttagaaaaggaaacaatatcatgagtaatgtgtgagcattatgggaccacgaaataaaaagaacattttgatgagtcgtgtatcctcgatgagcctcaaaagttctctcaccccggataagaaacccttaagcaatgtgcaaagtttgcattctccactgacataatgcaaaataagatatcatcgatgacatagcaactcatgcatcatatcatgcctctctcaacctattcattcctactcatctacataagtatcttcagctaaatgttagaacataaacccataagtcacgtttgatgagtattaggcgtgacacatgacaaatcacagactcaagcaagataaagcaaaatgatgtgtacataaaactccagagctatatgtcatattgcaaaaagaggagagcttataagacaaggcatgactcacaaaaattcatttgcctttcgtgtcaaaaagaggagggctttacattatccatgtcatattgcaaaagaaagagagaaagaacaacacaatgctgcgtcaattatacatatctgtatgtccatcattattcatccacctttcgtgtaccacacttcatatatcatgagtcacttcatgtctggacattaacaaactctatcttaacatttagatgcaagagcctttatctcactataaatgcacgatgatttctcattgtttctc

SEQ ID NO: 30470 - DNA, 1456 bp, Zea mays
tgtttggactccagaaaatttacgggagttggtggagcaggtcattaagtactataaaaaatcatgtagctgaagctgcaagtatttagaagacatttagataagttattttatttatcatttagattaagaaaatttaaaactatttaaattgatattataaactacagctccacactggagctagatcctggagtcattacaaacacccccttaatgggaaaagagaagataatgtatatctaattattgtttctgtgtcacctatagctattagttcaaaacttcataatcactggtacaaataagctctagagaggcggttcggaacccatttttattgttgtttttcaaaaccactagtgttagggaccgccagtggaaactgaaacgccattggaaattgattttcactgatggtgagctaagaaaaccgccattggtaatcctttgcagaaaacataaactaggttttaaaaatagtaaacaaatatttttattaggagaggccccacatagtcgcaccatttttcgcgcattattcacgcgctacgcaaccaatggtaattgaacctcagagacttcactcttgtgtagcctcctttgccactccactaaacacttacttgtgtcttgattgcattttgttgcccacatattagaacaaacagagtgtaaattgattgtttgaggctgtaaacaaattcaaatgaaaaagtagtcaactactaaattgaataattgtttatgttctaccacttttattttggtacttttcccatcggaggcggtttgtaaaatttgcattttaagttttacaaatttcaatgaaattttgagagcccaaatgatttcaaataaaaaagttgtcaactacaatgttttataacttttaatttggtggttttttaaacaagctcatttgaaaaactaaaatgatcgattctacatgatttttaggtcgattttttaaggaatcgcctgtacaaatatttctactgacagtttttaagaaaccacctgtggaaatcatagatttgtactagcggtttttctcaagtaactgctagtagaaatatggtggttttcttaagaaaactgtttgtaggaatgcacgatttatataaatggatttgttaagaaaaccgctagtggaatgttctttcaactaacggttattgagtcgtgacagccaatttaatttccttgataactaaaagcggctgtaaaaattagaccatgatgtaggcacggagctgttttgtactgaatgcgcccactgttttgttggaaaagtgcatgtacttattattcattctgtttatttctagctggcattcagttcttacagccacagattatgcaaaacgcctatttctgccagcaaatttacaggaaaagtcatggacttttccgggttattttcctataagtacagccattcctttcacttaca

SEQ ID NO: 30471 - DNA, 838 bp, Hordeum vulgare
catcgattttaaaaaaaagttcatacctttcaaaaacgttcatcaatttttttaaaaagttcactaaaaatgaaaaaaagttcatccaatttaaaaaaagttcattaattttttataaatttcaataaatttgaaaaaacttcataaaattcaacaaaagttcattgaagtgaaaaaagctcataaatctttaaaaagtgcatccattttcaaaaagatgttcatcaaaattcaatatagttcaccaatattcaaaaaagttcattaatcttaaaaaatattcgctaaaatttaaaaaatgtttatcaatatttaaacggcgtctagatgagccggtctatttacaaacaccataggcgccaattaacaaaaatgcacgttagatcacgtctacggcgtcaaataggaaatgcccatcggccttactattaagagttgttttggttatcctttaggatttatgctgtgggctggacttaacacaaaacccacagccatggtaggccggaatctattattcagctcacaaacgatgttctactcaaaagaagaaaaaaatctgttgtcagaaaaagagaacaaaaaaggctcacgaacatgccgcggctcgcacaggtggccgtgagcttctgaatgacttggccacccggcatgtccactgcccccctagacggtgtgggtgggtggacaggtcaagcgcattgaacaaggtcaccctgcgttctgccacgaggccaactgcgtggccctcatgcaacgcgccttgctgccacttctacacacgccctcgccggccgaccgctgctataaaagcagctccccgttgcgtcctcgacgg

SEQ ID NO: 30472 - DNA, 1160 bp, Zea mays
atgtgctggtgccccataaggtaggcacctaggtctgtgtttgaagcatcgacagatttgtaaacatgttcctatgaacctatttctgattgataatttgtcaaaactcatcatttgtcttcatccttgcctgcttgcgttcacgtgacaaagtacgtgtatgtcttcggcctttgctgtgtatgtttcgcattgcttagatgtggtgaaagaacatcagaagatgcattgatggcgtgcttaaaccagtgatgtgctccaggtgttcctgcagtctgcagagatatttactcttgtagtcttgttgacagcacagttgtatgtgatttcttggatgtaatgtaaaccaaatgaaagataggaacagttcgtcctcttccgtatacgaaggtcactgtatcatttgtcgtggcacaagatgatctgcaggcaggactgcaacatggtttcttggactgtcctgaatgcccgttcttgttctttagttgagccagagcagcagcctggtgtcggtgcctgagacctgacgaagcacacggcaaacaaacaagtcgcagcagctagcaggggcgttgccatcgccacaagcccccaagagacccgccgaggaaaagaaaaaaaaactacggccgccgttgccaagccgagcgtgcgaaccgatccacggatgggagatcagagatcacccaccgcaggcgggcggcagtggctggcgaggtgcgtccacagaacctgctgcaggtccctgtccgtcccggcgaccccttttctaggcgagcaactccccatggcagagctgcacgcagcagggcccgtcgttggttgcagctttaaccctttttgttttaaccatacaatgcagagtcgcagaggtgaaacaggacggaaattacagaaaagatggtggtgtgccagcagccccagcatgaagaagatcaggacaaaagaaaagcttgtgattggtgacagcaacaggattggattggagccaagctaggcagtgagaggcaggcagcaagacgcgtcagccactgaaatccagagggcaacctcggcctcacaactcatatccccttgtgctgttgcgcgccgtggttagccaggtgtgctgcaggcctcctccttgtttatatatgggagatgctctcaccctctaaggt

SEQ ID NO: 30473 - DNA, 816 bp, Zea mays
cagatccacgctcgctcgggtgtcgggtcagatcgatccagttggcgcacgtaataatccttttccccagaaggagtcgaacccctcctccccgtccaatccaatcaaagcgaccaatcgactggctgtcctacacacacacaaaaccgaccgaggcgacacaccgcagcagtgatcattctgagcatttgcagaaaaaggagaacgtcccgaaatcctggtggttgtattgtgtgattgctcactcagtccgtgcagggtcagggtgaagccaagccaacaacccaacgctcgctgggagtagggtccaccggatttattggcagtacatcgctgtttggtcctcctgcccttcgcttattttttaattcggcagacgtgcacagacagggcaccaccggaccaaggaagggcgcacaccgtcgtcagtcaccaggtgggtgtgatcagcagccgcttctcttgtgctgctttatagcgtatgaaattccagtgtccctgttccacctgcatgcaattggtttgactgaacaacatgatagcaagtgatactatatatatttttatagaggaacacagtgaaaaaatatttagtattattacgtgcatgaaattgtattcacagttatccctgatgcaacgcaattgttcaatatatagcagtatatattatacgaagtatatatgtatatctaattttatgagaccgggagaaggtgtattcacagtacagtgcagggccatggccatgcagcccttggggcctgaaaagggtcgcgtgaagtggccaacgctgtgcaattgcaaccaaacaaa

SEQ ID NO: 30474 - DNA, 469 bp, Zea mays
ggtactcctgagatactataccctcctgttttaaaatagttggcattatcgaattatcattttactttttaatgttttctcttcttttaatatattttatgaattttaatgtattttaaaatgttatgcagttcgctctggacttttctgctgcgcctacacttgggtgtactgggcctaaattcagcctgaccgaccgcctgcattgaataatggatgagcaccggtaaaatccgcgtacccaactttcgagaagaaccgagacgtggcgggccgggccaccgacgcacggcaccagcgactgcacacgtcccgccggcgtacgtgtacgtgctgttccctcactggccgcccaatccactcatgcatgcccacgtacacccctgccgtggcgcgcccagatcctaatcctttcgccgttctgcacttctgctgcctataaatggcggcatcgaccgtcacctgcttc

SEQ ID NO: 30475 - DNA, 1039 bp, Zea mays
gtcccgcgtcaatattattaaaaaactcctacatttctttataatcaacccgcactcttataatctcttctctactactataataagagagtttatgtacaaaataaggtgaaattatgtataagtgttctggatattggttgttggctccatattcacacaacctaatcaatagaaaacatatgttttattaaaacaaaatttatcatatatcatatatatatatatacatatatatatatatatataaaccgtagcaatgcacgggcatataactagtgcaacttaatacatgtgtgtattaagatgaataagagggtatccaaataaaaaacttgttcgcttacgtctggatcgaaaggggttggaaacgattaaatctcttcctagtcaaaattgaatagaaggagatttaatctctcccaatccccttcgatcatccaggtgcaaccgtataagtcctaaagtggtgaggaacacgaaacaaccatgcattggcatgtaaagctccaagaatttgttgtatccttaacaactcacagaacatcaaccaaaattgcacgtcaagggtattgggtaagaaacaatcaaacaaatcctctctgtgtgcaaagaaacacggtgagtcatgccgagatcatactcatctgatatacatgcttacagctcacaagacattacaaacaactcatattgcattacaaagatcgtttcatgaaaaataaaataggccggacaggacaaaaatccttgacgtgtaaagtaaatttacaacaaaaaaaaagccatatgtcaagctaaatctaattcgttttacgtagatcaacaacctgtagaaggcaacaaaactgagccacgcagaagtacagaatgattccagatgaaccatcgacgtgctacgtaaagagagtgacgagtcatatacatttggcaagaaaccatgaagctgcctacagccgtctcggtggcataagaacacaagaaattgtgttaattaatcaaagctataaataacgctcgcatgcctgtgcacttctcc

SEQ ID NO: 30476 - DNA, 612 bp, Cauliflower mosaic
ggtccgattgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatggtccgattgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagagg

SEQ ID NO: 30477 - DNA, 1942 bp, Zea mays
atgtgctggtgccccataaggtaggcacctaggtctgtgtttgaagcatcgacagatttgtaaacatgttcctatgaacctatttctgattgataatttgtcaaaactcatcatttgtcttcatccttgcctgcttgcgttcacgtgacaaagtacgtgtatgtcttcggcctttgctgtgtatgtttcgcattgcttagatgtggtgaaagaacatcagaagatgcattgatggcgtgcttaaaccagtgatgtgctccaggtgttcctgcagtctgcagagatatttactcttgtagtcttgttgacagcacagttgtatgtgatttcttggatgtaatgtaaaccaaatgaaagataggaacagttcgtcctcttccgtatacgaaggtcactgtatcatttgtcgtggcacaagatgatctgcaggcaggactgcaacatggtttcttggactgtcctgaatgcccgttcttgttctttagttgagccagagcagcagcctggtgtcggtgcctgagacctgacgaagcacacggcaaacaaacaagtcgcagcagctagcaggggcgttgccatcgccacaagcccccaagagacccgccgaggaaaagaaaaaaaaactacggccgccgttgccaagccgagcgtgcgaaccgatccacggatgggagatcagagatcacccaccgcaggcgggcggcagtggctggcgaggtgcgtccacagaacctgctgcaggtccctgtccgtcccggcgaccccttttctaggcgagcaactccccatggcagagctgcacgcagcagggcccgtcgttggttgcagctttaaccctttttgttttaaccatacaatgcagagtcgcagaggtgaaacaggacggaaattacagaaaagatggtggtgtgccagcagccccagcatgaagaagatcaggacaaaagaaaagcttgtgattggtgacagcaacaggattggattggagccaagctaggcagtgagaggcaggcagcaagacgcgtcagccactgaaatccagagggcaacctcggcctcacaactcatatccccttgtgctgttgcgcgccgtggttagccaggtgtgctgcagggggtaccatggcatgcatcgatagatctcgagggatccaaagacatggaggtggaaggcctgacgtagatagagaagatgctcttagctttcattgtctttcttttgtagtcatctgatttacctctctcgtttatacaactggttttttaaacactccttaacttttcaaattgtctctttctttaccctagactagataattttaatggtgattttgctaatgtggcgccatgttagatagaggtaaaatgaactagttaaaagctcagagtgataaatcaggctctcaaaaattcataaactgttttttaaatatccaaatatttttacatggaaaataataaaatttagtttagtattaaaaaattcagttgaatatagttttgtcttcaaaaattatgaaactgatcttaattatttttccttaaaaccgtgctctatctttgatgtctagtttgagacgattatataattttttttgtgcttaactacgacgagctgaagtacgtagaaatactagtggagtcgtgccgcgtgtgcctgtagccactcgtacgctacagcccaagcgctagagcccaagaggccggaggtggaaggcgtcgcggcactatagccactcgccgcaagagcccaagagaccggagctggaaggatgagggtctgggtgttcacgaattgcctggaggcaggaggctcgtcgtccggagccacaggcgtggagacgtccgggataaggtgagcagccgctgcgataggggcgcgtgtgaaccccgtcgcgccccacggatggtataagaataaaggcattccgcgtgcaggatt

SEQ ID NO: 30478 - DNA, 786 bp, Zea mays
gacatggaggtggaaggcctgacgtagatagagaagatgctcttagctttcattgtctttcttttgtagtcatctgatttacctctctcgtttatacaactggttttttaaacactccttaacttttcaaattgtctctttctttaccctagactagataattttaatggtgattttgctaatgtggcgccatgttagatagaggtaaaatgaactagttaaaagctcagagtgataaatcaggctctcaaaaattcataaactgttttttaaatatccaaatatttttacatggaaaataataaaatttagtttagtattaaaaaattcagttgaatatagttttgtcttcaaaaattatgaaactgatcttaattatttttccttaaaaccgtgctctatctttgatgtctagtttgagacgattatataattttttttgtgcttaactacgacgagctgaagtacgtagaaatactagtggagtcgtgccgcgtgtgcctgtagccactcgtacgctacagcccaagcgctagagcccaagaggccggaggtggaaggcgtcgcggcactatagccactcgccgcaagagcccaagagaccggagctggaaggatgagggtctgggtgttcacgaattgcctggaggcaggaggctcgtcgtccggagccacaggcgtggagacgtccgggataaggtgagcagccgctgcgataggggcgcgtgtgaaccccgtcgcgccccacggatggtataagaataaaggcattccgcgtgcaggatt

SEQ ID NO: 30479 - DNA, 932 bp, Arabidopsis thaliana
aaacatgttttatgtaactactttgcttatgtgattgcctgaggatactattattctctgtctttattctcttcacaccacatttaaatagtttaagagcatataaattaattatcttcaaaaaggtgattatatgcatgcaaaatagcacaccatttatgtttatattttcaaattatttaatacatttcaatatttcataagtgtgattttttttttttttgtcaatttcataagtgtgatttgtcatttgtattaaacaattgtatcgcgcagtacaaataaacagtgggagaggtgaaaatgcagttataaaactgtccaataatttactaacacatttaaatatctaaaaagagtgtttcaaaaaaaattcttttgaaataagaaaagtgatagatatttttacgctttcgtctgaaaataaaacaataatagtttattagaaaaatgttatcaccgaaaattattctagtgccactcgctcggatcgaaattcgaaagttatattctttctctttacctaatataaaaatcacaagaaaaatcaatccgaatatatctatcaacatagtatatgcccttacatattgtttctgacttttctctatccgaatttctcgcttcatggtttttttaacatattctcatttaattctcattactattatataactaaaagatggaaataaaataaagtgtctttgagaatcgaacgtccatatcagtaagatagtttgtgtgaaggtaaaatctaaaagatttaagttccaaaaacagaaaataatatattacgctaaaaaagaagaaaataattaaatacaaaacagaaaaaaataatatacgacagacacgtgtcacgaagataccctacgctatagacacagctctgttttctcttttctatgcctcaaggctctcttaacttcact

SEQ ID NO: 30480 - DNA, 809 bp, Oryza sativa
ttgacatacaaccaatgataccattttttttcaagcagctagaggtacagaggttcatattctttagatggctcattagtgatattttagtcaaaaatttcagaagtacggccacgggtgatggcctgaactaatattttattcgaggtgccgctacatcatcgtctaaagtacacgcaagattcaacggaaaaaagaaaccgatcgatcgagatcagttagttaatgaaataactagatcaactcatgtcgtcaaaaacaaaagatgctcatctatggacaacacacgctgatgattcgatcatcaaacaaaggtggtagtagtagtaaagcgtatcgtgtttctcatcagaaagaagaattaaagaaaaaactaatcccctctcgcgagccagagaaaattccctacaaaagccactcctttgatttgacatgcaaaagcaaggctccactcctctactaccctacaactacacaacactgtctctctatctccaaaggcagtagctgtattggcttccagcttttcctctctacctctaatgatagcttggagcaagttcaatagtatagctaactactagctctaattcatctataatcaatctaatagcttattcatacaatagttatatactacattattaatatctggtcccatctatcatacacactgagtctgtgctatagctgactacaaatctgtagcccgctgctcttctctcttcatttatcttcttaaaatatatttgcagctggcttatggcttatagcttgatattgagagggagaggagtgagagctagctc

SEQ ID NO: 30481 - DNA, 1186 bp, Oryza sativa
ctcgaggtcattcatatgcttgagaagagagtcgggatagtccaaaataaaacaaaggtaagattacctggtcaaaagtgaaaacatcagttaaaaggtggtataaagtaaaatatcggtaataaaaggtggcccaaagtgaaatttactcttttctactattataaaaattgaggatgtttttgtcggtactttgatacgtcatttttgtatgaattggtttttaagtttattcgcttttggaaatgcatatctgtatttgagtcgggttttaagttcgtttgcttttgtaaatacagagggatttgtataagaaatatctttagaaaaacccatatgctaatttgacataatttttgagaaaaatatatattcaggcgaattctcacaatgaacaataataagattaaaatagctttcccccgttgcagcgcatgggtattttttctagtaaaaataaaagataaacttagactcaaaacatttacaaaaacaacccctaaagttcctaaagcccaaagtgctatccacgatccatagcaagcccagcccaacccaacccaacccaacccaccccagtccagccaactggacaatagtctccacacccccccactatcaccgtgagttgtccgcacgcaccgcacgtctcgcagccaaaaaaaaaaagaaagaaaaaaaagaaaaagaaaaaacagcaggtgggtccgggtcgtgggggccggaaacgcgaggaggatcgcgagccagcgacgaggagcttaggcctcatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgaggcctcatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgaagctccctccctccgcttccaaagaaacgccccccatcgccactatatacatacccccccctctcctcccatccccccaaccct

SEQ ID NO: 30482 - DNA, 1528 bp, Zea mays
cacggctcacaataccagtcatctacatgtgataaattttatagttagattacttcttgtaatcatttcagaggatgaaaaaaaaatcgcaagaaagcaaatattttaaatgaatgatgcaatatacaaatttaattacacaattatgtaagattacattgtttagtttcatagaaatcaatttctagagtcataataatgcctaaattaaaattctattctatttttccttaagaaaaaaaacagcccattaaggaccattagaatgcgcgctgctccatttttttatatatagagatatgagttgttgctcactaggccactccacctcgcatgcgtgttctttattacatgaaaaaatgagccgctgcttttgcattaagggtctagagatgtacgagtgcaacgcttcgtattcactgcacgagtaatttttttttaatgcacggaggcgctttgtattcctcagcagctctgcgcgcccgtgcttcgtgtacggcagtgacgaggcagcagcagctctacgtgcccacgtgcctggctgcctgcccaccgtgatggcaaggcttgcttgcttgcgtgcctgcgtgtggcagcgacgaggttgaagctacggcggtggctgcttgcctgcgcgcgtgctagcacggcgacgacgtcgacgctgatgctagcgttgctacttttgtttttgttttctctgtgcttgcgatgatgcagtaaaataaacgtgtgtatctcatgtgattgatcgacgtgtgtcggcgatttcaaatcagtaacaatcacatgtgcatccccatcgacttcgtgtcggcgataaatctgctagggatttgtgcttttcatgtatgtgcttgaatagagaggaaagaataatattacataaaatatgagttcaacatctttcttaataccttttgctcgatctccttagtagagccacgtgcgtgataacgtgttaagaaccccttgctaccgagtgtagtccaagggctgcttaactgaataatagtagaacacaaggagacaagagtgtagagaggaactgattctttgttactatatggtgctgctctccaaaggttacatgatatggggatctcctctctatttatagacaaaactagggtttcaggcatatgggccacataggccttcctggcccaagaaaggtttcttaacactaccatcttccaggcgcggtcgtgcgtgcttcaactccttccctccgcctccagagcggataaatacggggtctacggtgcacgcgcacgcatggtgcgccgaggggcatctctgcccggggaatgcgcgcaggccatcgctcgacacgcacgtacgtgtcgcccccgcgaggcctcctcgcacacgcgtcgcgccgcacgggcgccgagggaccttgcaattcgtccgcgtcggtgcacacgtccctggtccggcttgccggctttgccctggcctcgcgcgcgacgtgccgcgtctccccaccggacggctataaaaaggcggcgccacctgatcctcc

SEQ ID NO: 30483 - DNA, 696 bp, Zea mays
aaaccgaggattggattttacgcgcatagagagattactaattgattattctaagagataaagaagtagttagcctgtacaacctctcttgcatgcatcacatgatgaactccatattatatatcatggttttaatacatttttaccatcttacgtaatcttgtgccgcgcaaatggtttgctatggcttcactcttctcttctgcgtgtgaagcgcaaccgcttaaaagcatataaaccatcttctcgggcatatagatttcttaatgacaatctcgcattgtttattgcctcacatggtgacacacagctcttacatttgtccttatactcacggtgcagtgcactactactgtaaccccatggtctggaaaacagcaacgcaacctttctgccttggaacagcaagctatacagcgctatataacaaacttgcacaataatatgctacatttctgaaagcaaactccgcttatcttcgcgttaaggaatggtattacacttaaaatgacaaaatatcacactttagaaccccacgcctttacctaaaaaaaagttgattgatacaagaacaaatgtttacagcttgttacacctcccatcaagcaaagaaatggaatcttttattttatgtacacgtgtacgggtagctattgtttataaattgcagaagacacctcaacatgatggataatt

SEQ ID NO: 30484 - DNA, 1858 bp, Oryza sativa
gcagccataggtttgccagatgaccaatctctttttacgtaacacttagcacgtattattagaaaaaaaacacccaaaattttagaatttcactatggaatgtttttctctgtcgccatgatctagcaagcaaaactacaatacattgagttctctgattgatgaactgattatgattccaacccaattaagctttacttgcttttctttccaggggttgcccacatgtggtcatgatcaacacagctgggggggaggaacaaaattaataaagcgagttgatcaaacagcgcaagaacagcaagcagcttttcaggcacacatgggggtgtactaaaatagcctgaaattcttccatccttccccaaaatcaagatcccatcggatcatatcatcagtcaggcagacgacagcgcaggcaacagctgttcctggctgtgttgctgccatgcctagcttaggttaattgtgctgatcccacttgattagcgcactaatcgcacctttaatccgtattgcccgtgtgtgttaatgtatgtgcaccgttaacgcgataattagttaagagcccggacaccatggttttctttttctatgaagaaatgttcaaatggaaggataatatatccttttgaaaaagcattgattaccaagatttgtttggaaacaaatttatcagcattatgaagaaaatcaattcatgcacgaaattgaagaaaattaatgtgatccaaacgaggcctaacatggtttttcttttcttaaatataaaaaggtgtaaattacacatatatcgttacctcaaatcatactggattatatttaaaaaaatctctcagattatttttaaaaaagcatatggatggatgcatgtagactatatgtacaagtacaatattactactaactcatgtaaaaagaaccgatcatatatattacaaaacactggcatacgacctagctgtcaactaggctaacaatataattatggaagaggagtgagaaaaaacaagtaaaataaggcacaaaggaagaatatagagacacatttttaattttaaattgtgttcttgtaaagaataaatttttgtttgcattataaaactaagttatattagtacattttaagtggtttacttgtatagcaaataagttacatgctctaccatgtcgagatattataggtgatgaaccggttataatcaccttgaggtatgcactagcacccttgacgagcactctactacctgcctacgctcgtgaaaatggtcattgaccaaatatgtggataaagatgacgtcttcttcatcatgcttgtatgaaaattttcataggtgctcctatttcaatccatgctggactgtgaaaagaaatactaccatctagtttgtttttcagctcgacataaccgaagttgatgagagatcgtgttaggagaactcgtaggctcctcctttttttttcttttttttgccaaatgccgtacaacgtattagagaaaaaataatttataggtaaattttttatgtatgtattcttagcgatttaaaattgaatgtaaaagataaacttagatgaaaaagaacctgaaagcaaaccttaaactttaaattttggaagcgggattcagtatagacaaacccatagagccatagagggtcctatttttgttttgggacagacaggcgccaacttctcagttctcagattcagagcgtaaccgtacccaagaagtgaaaaaagaaaaatcagagcgcgcttaattgtgtccaaaaaatgattgtgtggccctagtcgaggaacccccctctcttctcttatctacccctccccctccccccctcgactccgcgtcga

SEQ ID NO: 30485 - DNA, 1181 bp, Oryza sativa
catcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgaggcctcatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgaagcttactcgaggtcattcatatgcttgagaagagagtcgggatagtccaaaataaaacaaaggtaagattacctggtcaaaagtgaaaacatcagttaaaaggtggtataaagtaaaatatcggtaataaaaggtggcccaaagtgaaatttactcttttctactattataaaaattgaggatgtttttgtcggtactttgatacgtcatttttgtatgaattggtttttaagtttattcgcttttggaaatgcatatctgtatttgagtcgggttttaagttcgtttgcttttgtaaatacagagggatttgtataagaaatatctttagaaaaacccatatgctaatttgacataatttttgagaaaaatatatattcaggcgaattctcacaatgaacaataataagattaaaatagctttcccccgttgcagcgcatgggtattttttctagtaaaaataaaagataaacttagactcaaaacatttacaaaaacaacccctaaagttcctaaagcccaaagtgctatccacgatccatagcaagcccagcccaacccaacccaacccaacccaccccagtccagccaactggacaatagtctccacacccccccactatcaccgtgagttgtccgcacgcaccgcacgtctcgcagccaaaaaaaaaaagaaagaaaaaaaagaaaaagaaaaaacagcaggtgggtccgggtcgtgggggccggaaacgcgaggaggatcgcgagccagcgacgaggccggccctccctccgcttccaaagaaacgccccccatcgccactatatacatacccccccctctcctcccatccccccaaccct

SEQ ID NO: 30486 - DNA, 443 bp, Zea mays
cctagcgtcccctgcccaaaagtgggctcaacaagcctaaatacatataatttataccacgtgcaacacatttattcatccatatcacatgtcatgcaaggcataagcatcatgttaacttagttatactgacatacatttatgagttgagatgtccaggatgtgagcgcatgagcccattgtccattcaggaccaagacaggctactaagcactttctacataacttgtatgtgctaactatagcatgcttatatggctctctccaaagttcaaagctagctcaaatcttttgatttaataaaacttaaatttgtttgatttcagataaactgataatttttataatatttagagtgagttgaaaacagaaactggccgcaaatccacctcaagccttttgatttgacctaaaaaaaagaagcccccacaaacaccactcca

SEQ ID NO: 30487 - DNA, 1528 bp, Oryza sativa
ggaagctaactagtcacggcgaatacatgacgacatcggcctacaacgcacaacttcttggcataaaagcttcaatttcaatgcccctatctggaagccctaggcgccgcgcaaatgtaaaacattcgcttcgcttggcttgttatccaaaatagagtatggacctccgacagattggcaacccgtgggtaatcgaaaatggctccatctgcccctttgtcgaaggaatcaggaaacggccctcacctcctggcggagtgtagatatgtgaaagaatctaggcgacacttgcagactggacaacatgtgaacaaataagaccaacgttatggcaacaagcctcgacgctactcaagtggtgggaggccaccgcatgttccaacgaagcgccaaagaaagccttgcagactctaatgctattagtcgcctaggatatttggaatgaaaggaaccgcagagtttttcagcaccaagagcttccggtggctagtctgatagccaaaattaaggaggatgccaaaacatgggtcttggcgggcgcgaaacaccttgataggtggcttaccttttaacatgttcgggccaaaggccttgagacggtaaagttttctatttgcgcttgcgcatgtacaattttattcctctattcaatgaaattggtggctcactggttcattaaaaaaaaaagaatctagcctgttcgggaagaagaggattttattcgtgagagagagagagagagagagagagagagggagagagaaggaggaggaggattttcaggcttcgcattgcccaacctctgcttctgttggcccaagaagaatcccaggcgcccatgggctggcagtttaccacggacctacctagcctaccttagctatctaagcgggccgacctagtagctacgtgcctagtgtagattaaagttggcgggccagcaggaagccacgctgcaatggcatcttcccctgtccttcgcgtacgtgaaaacaaacccaggtaagcttagaatcttcttgcccgttggactgggacacccaccaatcccaccatgccccgatattcctccggtctcggttcatgtgatgtcctctcttgtgtgatcacggagcaagcattcttaaacggcaaaagaaaatcaccaacttgctcacgcagtcacgctgcaccgcgcgaagcgacgcccgataggccaagatcgcgagataaaataacaaccaatgatcataaggaaacaagcccgcgatgtgtcgtgtgcagcaatcttggtcatttgcgggatcgagtgcttcacggctaaccaaatattcggccgatgatttaacacattatcagcgtagatgtacgtacgatttgttaattaatctacgagccttgctagggcaggtgttctgccagccaatccagatcgccctcgtatgcacgctcacatgatggcagggcagggttcacatgagctctaacggtcgattaattaatcccggggctcgactataaatacctccctaatcccatgatcaaaacc

SEQ ID NO: 30488 - DNA, 1696 bp, Arabidopsis thaliana
caaatttattatgtgttttttttccgtggtcgagattgtgtattattctttagttattacaagacttttagctaaaatttgaaagaatttactttaagaaaatcttaacatctgagataatttcagcaatagattatatttttcattactctagcagtatttttgcagatcaatcgcaacatatatggttgttagaaaaaatgcactatatatatatatattattttttcaattaaaagtgcatgatatataatatatatatatatatatatgtgtgtgtgtatatggtcaaagaaattcttatacaaatatacacgaacacatatatttgacaaaatcaaagtattacactaaacaatgagttggtgcatggccaaaacaaatatgtagattaaaaattccagcctccaaaaaaaaatccaagtgttgtaaagcattatatatatatagtagatcccaaatttttgtacaattccacactgatcgaatttttaaagttgaatatctgacgtaggatttttttaatgtcttacctgaccatttactaataacattcatacgttttcatttgaaatatcctctataattatattgaatttggcacataataagaaacctaattggtgatttattttactagtaaatttctggtgatgggctttctactagaaagctctcggaaaatcttggaccaaatccatattccatgacttcgattgttaaccctattagttttcacaaacatactatcaatatcattgcaacggaaaaggtacaagtaaaacattcaatccgatagggaagtgatgtaggaggttgggaagacaggcccagaaagagatttatctgacttgttttgtgtatagttttcaatgttcataaaggaagatggagacttgagaagttttttttggactttgtttagctttgttgggcgtttttttttttgatcaataactttgttgggcttatgatttgtaatattttcgtggactctttagtttatttagacgtgctaactttgttgggcttatgacttgttgtaacatattgtaacagatgacttgatgtgcgactaatctttacacattaaacatagttctgttttttgaaagttcttattttcatttttatttgaatgttatatatttttctatatttataattctagtaaaaggcaaattttgcttttaaatgaaaaaaatatatattccacagtttcacctaatcttatgcatttagcagtacaaattcaaaaatttcccatttttattcatgaatcataccattatatattaactaaatccaaggtaaaaaaaaggtatgaaagctctatagtaagtaaaatataaattccccataaggaaagggccaagtccaccaggcaagtaaaatgagcaagcaccactccaccatcacacaatttcactcatagataacgataagattcatggaattatcttccacgtggcattattccagcggttcaagccgataagggtctcaacacctctccttaggcctttgtggccgttaccaagtaaaattaacctcacacatatccacactcaaaatccaacggtgtagatcctagtccacttgaatctcatgtatcctagaccctccgatcactccaaagcttgttctcattgttgttatcattatatatagatgaccaaagcactagaccaaacct

SEQ ID NO: 30489 - DNA, 1046 bp, Glycine max
gtcaattagcatgacaatcacgagaacaaattagttaagtatttcaatgaagacaaattaaataaaagttaaattatttgttagtttttgaattatttggtagcactttttaattaagttttagaaattattattttaaataggtttttttaacttacatttattttttaaacttttttatattcttctattttattatacgaatttaattaaattaataatataaatactttttgtattattatttaattataaattattatagtatgtactgaaattctgagttttataataattatttaaaaaatgtataaagtaatttctaattaagtaatacataaaatttaaattataatattaatatgcaagcaactttaccactccggttgtattctcccgcggctcttgaatcttgatgtaaaactcgtgccgccgcgagttgccgtcggaggaggcggtggggttaaccattggtggttgccggcgaagaggaaaaagagaaaggaattcagtgaagaggttacaatattgcatctggtagaactgcaacatctaacggttctgcaataacacacaagttggacactaattattcattttatttatatctacaaaccttacttcatctaaatatagcttaattacattgaaacactttttacacctaatcatacagaaagtgtaagtaaatttacatttttaggttagaataaggaagggatttgcatttgtgtgtgtgtggtccagtgggttttgcttggctttgtctcaaaaagacaaactaaggacttcacaacaattctctacaagctgaattagtagtatgtaagctacataaggacaaataaattggaatgtggaatatgtttcccaaatccccatccaaatatggaaataggataggacactaaagaattgtatagagaactctagatctcaccaagaacccaagtcacaatcataaaagataagatttttttaatgcttatctgggtccagaaaagtccaatgcatcctataaatttaaatgcaaacgtcagcttctc

SEQ ID NO: 30490 - DNA, 537 bp, Arabidopsis thaliana
actaaatctagccttttcagaccggacatgaacttcgcatattggcgtaactgtgcagttttacctttttcggatcagacaagatcagatttagaccacccaacaatagtcagtcatatttgacaacctaagctagccgacactactaaaaagcaaacaaaagaagaattctatgttgtcattttaccggtggcaagtggacccttctataaaagagtaaagagacagcctgtgtgtgtataatctctaattatgttcaccgacacaatcacacaaacccttctctaatcacacaacttcttcatgatttacgacattaattatcattaactctttaaattcactttacatgctcaaaaatatctaatttgcagcattaatttgagtaccgataactattattataatcgtcgtgattcgcaatcttcttcattagatgctgtcaagttgtactcgcacgcggtggtccagtgaagcaaatccaacggtttaaaaccttcttacatttctagatctaatctgaaccgtcagatatct

SEQ ID NO: 30491 - DNA, 954 bp, Arabidopsis thaliana
ttgtgttctgttttgagtcttacattttcaatatctgactctgattactatatctaaaagggaacatgaagaacttgagaccatgttaaactgtacaatgccttcaaacatggctaactaaagatacattagatggctttacagtgtgtaatgcttattatctttaggttttttaaatcccttgtattaagttatttaccaaattatgttcttgtactgcttattggcttggttgttgtgtgctttgtaaacaacacctttggctttatttcatcctttgtaaacctactggtctttgttcagctcctcttggaagtgagtttgtatgcctggaacgggttttaatggagtgtttatcgacaaaaaaaaaatgtagcttttgaaatcacagagagtagttttatattcaaattacatgcatgcaactaagtagcaacaaagttgatatggccgagttggtctaaggcgccagattaaggttctggtccgaaagggcgtgggttcaaatcccactgtcaacattctctttttctcaaattaatatttttctgcctcaatggttcaggcccaattatactagactactatcgcgactaaaatagggactagccgaattgatccggcccagtatcagttgtgtatcaccacgttatttcaaatttcaaactaagggataaagatgtcatttgacatatgagatatttttttgctccactgagatatttttctttgtcccaagataaaatatcttttctcgcatcgtcgtctttccatttgcgcattaaaccaaaaagtgtcacgtgatatgtccccaaccactacgaattttaactacagatttaaccatggttaaaccagaattcacgtaaaccgactctaaacctagaaaatatctaaaccttggttaatatctcagcccccttataaataacgagacttcgtctacatcgttct

SEQ ID NO: 30492 - DNA, 901 bp, Arabidopsis thaliana
aaaccgaccggagccaaccaaaccggttaacatcctaaaaccaatcatattttattaagttttgtgttgatgctaaaccaaaaatcattggcatgcatatttctaaatttagtaataaacaaaaacacttagaaatcacacgttcactatactaaaaaacgttgacaaaaacacaacaactatactaataattaaagaagagaaaactgaaccaaactttttgtaaactcctgaatttaaattagtaattgaagtaagaagatgaagaagaacatgttaagcaaacaaaaaaattacactaaaatcatataaaaatacataattacaaaagtacccataagatggatttattgatatgggtcatctgtgaaacaagccacagagagacaaagactcgtaagtattgggcaacgaaagcgacctcctttattcaccactgccattaacatgttcttcttctccttcttcttctacattttatgaccgttttacccttcaagagagagaaacaaaatcactccctctcactcactctatctctctcttctgcaaagcttcagaactctggcagagagataaaagatgatggggtttttaactttatcctccccaaataattcttcttcccttcatctctctctcttacacaacaggtccctacatttgtacaatctcctctctttaaagactctctctctttctctctccatctctatcttactctgtatttctgtcgtctgagcactcaatgaaaccactgtaaatttccgccagaatttgatgtgatggaacgataaaaatcattttttctcggttaaagtaaaaaaacaaaaacaaatttctgtagaaatcataataaaagaaagaaaaaaaatctaatgtcggtacataatacggttct

SEQ ID NO: 30493 - DNA, 23 bp, Oryza sativa
acaaaaagcattcagttcattag

SEQ ID NO: 30494 - DNA, 46 bp, Zea mays
ggccccaacattagcacaaagaacacaatagaccactgatttaaca

SEQ ID NO: 30495 - DNA, 65 bp, Hordeum vulgare
catccatcgagagacgttcgcagcagcaaagagcacgcagcaactagctttcagttgtttcaacc

SEQ ID NO: 30496 - DNA, 93 bp, Zea mays
aaggaaggagaagaagacgagtgtcaagtgaacctgaaacttgcggtgtcactggctggtagcctgagtgtgagtgagtgatcgagctagctg

SEQ ID NO: 30497 - DNA, 239 bp, Zea mays
cttttggtggcggggtccctgtccctggccggctttgcccacaggccacagcgcatcacaccaccgctttatagcgccaccccaccaccctcgtctctccccccgtcgagcacacaacacaccctcctcgtcctccaatccaatcaacctggtagactcgcttcgcttctccccccagctcggacggagctcctcgcagcagccgccgatcaacctgcgctcgggctcagcgctggaag

SEQ ID NO: 30498 - DNA, 93 bp, Zea mays
accaccggcgagccacatcgagaacacgatcgagcacacaagcacgaagactcgtttaggagaaaccacaaaccaccaagccgtgcaagcacc

SEQ ID NO: 30499 - DNA, 61 bp, Zea mays
atcaccaccactgggtcttcagaccattagctttatctactccagagcgcagaagaacccg

SEQ ID NO: 30500 - DNA, 9 bp, Cauliflower mosaic
acacgctga

SEQ ID NO: 30501 - DNA, 165 bp, Zea mays
cacccgttcgcctctcaccttttcgctgtactcactcgccacacacaccccctctccagctccgttggagctccggacagcagcaggcgcggggcggtcacgtagtaagcagctctcggctccctctccccttgctccatttgatagtgcaacccatcgagctac

SEQ ID NO: 30502 - DNA, 66 bp, Arabidopsis thaliana
gtctcctcttcggataatcctatccttctcttcctataaatacctctccactcttcctcttcctcc

SEQ ID NO: 30503 - DNA, 212 bp, Oryza sativa
agctcagctcaaggtaaacaacaaggcacactcttcctacctcttctccggttcttcctttttcctctttctcttcgtccaagaacttcacctcaatagctcgagctacggcctaacttttgcgttgcgcaggagagctcgatcgctgcaccaatacttcactggagatcgcctagctgcagctagctagcttatcctgcgtgtcttgagct

SEQ ID NO: 30504 - DNA, 61 bp, Triticum aestivum
aaccatcttccacacactcaagccacactattggagaacacacagggacaacacaccataa

SEQ ID NO: 30505 - DNA, 119 bp, Zea mays
atctcacacaagcaaagcagcagcaacagccaacacctaaactaaagaacagtagtagtccctgtgtacgtctagcaacgatccgcgccgagctcgccagttttgctcgttagtttggg

SEQ ID NO: 30506 - DNA, 80 bp, Zea mays
gtatacgcaaaactactttcctcgaattccccattctataaattccagttaaacttaattcgtaagatcaatcataattc

SEQ ID NO: 30507 - DNA, 135 bp, Oryza sativa
ctccactctcgcctcctcgcgactcggagttcaccgccgccaccgcctccgccgccgatctccccgtcccgccgcgccgccgccaccgtcctccctcctccggccgcatccccggaattcagaaccagtaggagg

SEQ ID NO: 30508 - DNA, 89 bp, Unknown
  Petunia hybrida
cagaaaaatttgctacattgtttcacaaacttcaaatattattcatttatttgtcagctttcaaactctttgtttcttgtttgttgatt

SEQ ID NO: 30509 - DNA, 293 bp, Zea mays
cactagtgcactgtctctctccaaaggcagctgcattggcctccagccttttccctactgtgccgcgcgccctcccttctctctaataatagcatagggagagaaggcatactccgaggcatccttctcctttccctctccttccccaaacccttttcctctttccctcgccccaagaacttcatctcatctccaggcgccccttttgcgcttgcgcaggaggagctcacggggacagtgggcggagagctcgatcgctgcaccactacttcactggaggtccgcccactccc

SEQ ID NO: 30510 - DNA, 99 bp, Oryza sativa
atctcaagcagcctaatcatctccagctgatcaagagctcttaattagctagctagtgattagctgcgcttgtgatcgatcgatctcgggtacgtagca

SEQ ID NO: 30511 - DNA, 18 bp, Arabidopsis thaliana
cagtcacacaaagagtaa

SEQ ID NO: 30512 - DNA, 58 bp, Glycine max
aatattctataccttacaatagcattggcatccctctagcatcgttgtctaacagaaa

SEQ ID NO: 30513 - DNA, 182 bp, Arabidopsis thaliana
agatctcattgtctgaacacagttagataaaactgggaataaatctggacgaaattacgatcttacaccaaccccctcgacgagctcgtatatataaagcttatacgctcctccttcaccttcgtactactactaccaccacatttctttagctcaaccttcattactaatctccttttaag

SEQ ID NO: 30514 - DNA, 46 bp, Arabidopsis thaliana
acacatctcactgctcactactctcactgtaatcccttagatcttc

SEQ ID NO: 30515 - DNA, 93 bp, Arabidopsis thaliana
cttcttcttctctatcctctgtttcttcttcatagagacttgaaagcttttaaagtatatctaaaaacgcagtcgttttaagactgtgtgtga

SEQ ID NO: 30516 - DNA, 804 bp, Zea mays
accgtcttcggtacgcgctcactccgccctctgcctttgttactgccacgtttctctgaatgctctcttgtgtggtgattgctgagagtggtttagctggatctagaattacactctgaaatcgtgttctgcctgtgctgattacttgccgtcctttgtagcagcaaaatatagggacatggtagtacgaaacgaagatagaacctacacagcaatacgagaaatgtgtaatttggtgcttagcggtatttatttaagcacatgttggtgttatagggcacttggattcagaagtttgctgttaatttaggcacaggcttcatactacatgggtcaatagtatagggattcatattataggcgatactataataatttgttcgtctgcagagcttattatttgccaaaattagatattcctattctgtttttgtttgtgtgctgttaaattgttaacgcctgaaggaataaatataaatgacgaaattttgatgtttatctctgctcctttattgtgaccataagtcaagatcagatgcacttgttttaaatattgttgtctgaagaaataagtactgacagtattttgatgcattgatctgcttgtttgttgtaacaaaatttaaaaataaagagtttcctttttgttgctctccttacctcctgatggtatctagtatctaccaactgacactatattgcttctctttacatacgtatcttgctcgatgccttctccctagtgttgaccagtgttactcacatagtctttgctcatttcattgtaatgcagataccaagcgg

SEQ ID NO: 30517 - DNA, 985 bp, Zea mays
gtgagagctcagtgcctcgtcccgcccgccccaaatctggttcttgtgctggctctggctgtgcgctgcacgaattctgcatctggttctttcgagacgcaattcccggaccgtgggctttggtttcggagggggccgagagtaaggcgttaggactttctccgagctgcaaggccgctcgtcgttgcggcatttttcgtttcgcttgtcctgtgatgagagatgtgcatttccctttggcgggcttaccgttccctgctcgtctgtatgtgtgtatgtttgtgtgacctttccctcaacgccaggctcttctcccctcttgctgtttctttcagcagtacagacgcgcatctgtacagcgcctttcttcggtcctgggttatgattgatccgttaacagttggtcaccaagtgctggctgtttaatatgtactataagcttcttggtgccgctgcctctgcctatacgactttatgcgctgcctgcacaagtctcagccatctgtgggaacgtgtgtctctcacctacctttcatattgcactagctggattgaatcattctgctttggagagatgtccggtcatttttttttaaatcattttcatctcgcgtactagtttttgttttgttttgcgagagagtaatttttttttaatatttactgtctcctgtcccatttgctgtttctttacccagaaatttccaccagattcagtcaaacgaaactcctgtgctcttttttttctccctttcaaaagggtgtgtaaccgactaccgactcagataatataagtgcggtcacatatcacatgatatcatctcgcctctctcccttctcctgtgttttattttccttttttctaaccacagcgtgatgaacttcttttttttttgggggggggggggggggtaactacagcttagcgaacatgaatgggtagttttacaactaatgcaacggctggttcactgaacaactgtag

SEQ ID NO: 30518 - DNA, 480 bp, Oryza sativa
ccgccgccgccggtaaccaccccgcccctctcctctttctttctccgtttttttttccgtctcggtctcgatctttggccttggtagtttgggtgggcgagaggcggcttcgtgcgcgcccagatcggtgcgcgggaggggcgggatctcgcggctggggctctcgccggcgtggatccggcccggatctcgcggggaatggggctctcggatgtagatctgcgatccgccgttgttgggggagatgatggggggtttaaaatttccgccgtgctaaacaagatcaggaagaggggaaaagggcactatggtttatatttttatatatttctgctgcttcgtcaggcttagatgtgctagatctttctttcttctttttgtgggtagaatttgaatccctcagcattgttcatcggtagtttttcttttcatgatttgtgacaaatgcagcctcgtgcggagcttttttgtaggtagaag

SEQ ID NO: 30519 - DNA, 516 bp, Oryza sativa
gtgagcatccatctgcgtgtcctcttcctcatctctccctccccacgcacgcacgcacgtactcgtagcttctgttcactgttctagatctggatacttttcgcttcattcgccttattaaaccttgatgctggtagcagtttgtttgtttgtgtttttttccccgcgcgcaaaaaatgtttgtggggggtggaactgaatcacatgctccacgtctaggtccgccacctgagtttgccttgcatcacggtttagtgcttgattctttgtgcgcggttgattatcgcgtactctttttgctctacaagttctagatctcggtgtgtcggactatcgatatgtagttttgcatactctgttttgttttctgttcgctgcaagttttgatgtgccaaatattagcagttgatcttttgagattttgatttcctggagggtttgcgtctagtttctgttggaaaatggccatttcgtgacgtgttgcggcgcatgcctgttgttctgtttttgcgtcag

SEQ ID NO: 30520 - DNA, 208 bp, Arabidopsis thaliana
gtaagttcacttttcttcgattcatactttctcaagattcctgcatttctttagaatttgaaccaagtgtcgatttttgtttgagagaagtgttgatttatagatctggttattgaatctagattccaatttttaattgattcgagtttgttaagtgcgtttatactacttctcattgatcttgtttgatttctctgctctgtattag

SEQ ID NO: 30521 - DNA, 11722 bp, Artificial Sequence
  Synthetic DNA construct
cgcgcctgcctgcaggtactcgaggtcattcatatgcttgagaagagagtcgggatagtccaaaataaaacaaaggtaagattacctggtcaaaagtgaaaacatcagttaaaaggtggtataaagtaaaatatcggtaataaaaggtggcccaaagtgaaatttactcttttctactattataaaaattgaggatgtttttgtcggtactttgatacgtcatttttgtatgaattggtttttaagtttattcgcttttggaaatgcatatctgtatttgagtcgggttttaagttcgtttgcttttgtaaatacagagggatttgtataagaaatatctttagaaaaacccatatgctaatttgacataatttttgagaaaaatatatattcaggcgaattctcacaatgaacaataataagattaaaatagctttcccccgttgcagcgcatgggtattttttctagtaaaaataaaagataaacttagactcaaaacatttacaaaaacaacccctaaagttcctaaagcccaaagtgctatccacgatccatagcaagcccagcccaacccaacccaacccaacccaccccagtccagccaactggacaatagtctccacacccccccactatcaccgtgagttgtccgcacgcaccgcacgtctcgcagccaaaaaaaaaaagaaagaaaaaaaagaaaaagaaaaaacagcaggtgggtccgggtcgtgggggccggaaacgcgaggaggatcgcgagccagcgacgaggagcttaggcctcatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgaggcctcatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgaagctccctccctccgcttccaaagaaacgccccccatcgccactatatacatacccccccctctcctcccatccccccaacccttctagaaccatcttccacacactcaagccacactattggagaacacacagggacaacacaccataagatccaagggaggcctccgccgccgccggtaaccaccccgcccctctcctctttctttctccgtttttttttccgtctcggtctcgatctttggccttggtagtttgggtgggcgagaggcggcttcgtgcgcgcccagatcggtgcgcgggaggggcgggatctcgcggctggggctctcgccggcgtggatccggcccggatctcgcggggaatggggctctcggatgtagatctgcgatccgccgttgttgggggagatgatggggggtttaaaatttccgccgtgctaaacaagatcaggaagaggggaaaagggcactatggtttatatttttatatatttctgctgcttcgtcaggcttagatgtgctagatctttctttcttctttttgtgggtagaatttgaatccctcagcattgttcatcggtagtttttcttttcatgatttgtgacaaatgcagcctcgtgcggagcttttttgtaggtagaagcggaccggtcgcgcctcagcagtcgctgtcgttaacccagcggtactcgctgaggcgatcgcgggcccggtaccctgcaatgtgaccctagacttgtccatcttctggattggccaacttaattaatgtatgaaataaaaggatgcacacatagtgacatgctaatcactataatgtgggcatcaaagttgtgtgttatgtgtaattactaattatctgaataagagaaagagatcatccatatttcttatcctaaatgaatgtcacgtgtctttataattctttgatgaaccagatgcattttattaaccaattccatatacatataaatattaatcatatataattaatatcaattgggttagcaaaacaaatctagtctaggtgtgttttgctaattattgggggatagtgcaaaaagaaatctacgttctcaataattcagatagaaaacttaataaagtgagataatttacatagattgcttttatcctttgatatatgtgaaaccatgcatgatataaggaaaatagatagagaaataattttttacatcgttgaatatgtaaacaatttaattcaagaagctaggaatataaatattgaggagtttatgattattattattattttgatgttcaatgaagttttttttaatttcatatgaagtatacaaaaattcttcatagatttttgtttctatgccgtagttatctttaatatatttgtggttgaagaaatttattgctagaaacgaatggattgtcaatttttttttaaagcaaatatatatgaaattatactgtatattattttagtcatgattaaaatgtggccttaattgaatcatctttctcattcattttttcaaaagcatatcaggatgattgatatttatctattttaaaaattaatttaagggttcaaattaaatttaacttaaaagtgtcctaaccgtagttaaaggtttactttaaaaaaatactatgaaaaatctaatcttctatgaatcgacctgcaggatttaaatccatcgttctggggcctaacgggccaagcttactcgaggtcattcatatgcttgagaagagagtcgggatagtccaaaataaaacaaaggtaagattacctggtcaaaagtgaaaacatcagttaaaaggtggtataaagtaaaatatcggtaataaaaggtggcccaaagtgaaatttactcttttctactattataaaaattgaggatgtttttgtcggtactttgatacgtcatttttgtatgaattggtttttaagtttattcgcttttggaaatgcatatctgtatttgagtcgggttttaagttcgtttgcttttgtaaatacagagggatttgtataagaaatatctttagaaaaacccatatgctaatttgacataatttttgagaaaaatatatattcaggcgaattctcacaatgaacaataataagattaaaatagctttcccccgttgcagcgcatgggtattttttctagtaaaaataaaagataaacttagactcaaaacatttacaaaaacaacccctaaagttcctaaagcccaaagtgctatccacgatccatagcaagcccagcccaacccaacccaacccaacccaccccagtccagccaactggacaatagtctccacacccccccactatcaccgtgagttgtccgcacgcaccgcacgtctcgcagccaaaaaaaaaaagaaagaaaaaaaagaaaaagaaaaaacagcaggtgggtccgggtcgtgggggccggaaacgcgaggaggatcgcgagccagcgacgaggccggccctccctccgcttccaaagaaacgccccccatcgccactatatacatacccccccctctcctcccatccccccaaccctaccaccaccaccaccaccacctccacctcctcccccctcgctgccggacgacgagctcctcccccctccccctccgccgccgccgcgccggtaaccaccccgcccctctcctctttctttctccgtttttttttccgtctcggtctcgatctttggccttggtagtttgggtgggcgagaggcggcttcgtgcgcgcccagatcggtgcgcgggaggggcgggatctcgcggctggggctctcgccggcgtggatccggcccggatctcgcggggaatggggctctcggatgtagatctgcgatccgccgttgttgggggagatgatggggggtttaaaatttccgccgtgctaaacaagatcaggaagaggggaaaagggcactatggtttatatttttatatatttctgctgcttcgtcaggcttagatgtgctagatctttctttcttctttttgtgggtagaatttgaatccctcagcattgttcatcggtagtttttcttttcatgatttgtgacaaatgcagcctcgtgcggagcttttttgtaggtagaagtgatcaaccatggcgcaagttagcagaatctgcaatggtgtgcagaacccatctcttatctccaatctctcgaaatccagtcaacgcaaatctcccttatcggtttctctgaagacgcagcagcatccacgagcttatccgatttcgtcgtcgtggggattgaagaagagtgggatgacgttaattggctctgagcttcgtcctcttaaggtcatgtcttctgtttccacggcgtgcatgcttcacggtgcaagcagccggcccgcaaccgcccgcaaatcctctggcctttccggaaccgtccgcattcccggcgacaagtcgatctcccaccggtccttcatgttcggcggtctcgcgagcggtgaaacgcgcatcaccggccttctggaaggcgaggacgtcatcaatacgggcaaggccatgcaggcgatgggcgcccgcatccgtaaggaaggcgacacctggatcatcgatggcgtcggcaatggcggcctcctggcgcctgaggcgccgctcgatttcggcaatgccgccacgggctgccgcctgacgatgggcctcgtcggggtctacgatttcgacagcaccttcatcggcgacgcctcgctcacaaagcgcccgatgggccgcgtgttgaacccgctgcgcgaaatgggcgtgcaggtgaaatcggaagacggtgaccgtcttcccgttaccttgcgcgggccgaagacgccgacgccgatcacctaccgcgtgccgatggcctccgcacaggtgaagtccgccgtgctgctcgccggcctcaacacgcccggcatcacgacggtcatcgagccgatcatgacgcgcgatcatacggaaaagatgctgcagggctttggcgccaaccttaccgtcgagacggatgcggacggcgtgcgcaccatccgcctggaaggccgcggcaagctcaccggccaagtcatcgacgtgccgggcgacccgtcctcgacggccttcccgctggttgcggccctgcttgttccgggctccgacgtcaccatcctcaacgtgctgatgaaccccacccgcaccggcctcatcctgacgctgcaggaaatgggcgccgacatcgaagtcatcaacccgcgccttgccggcggcgaagacgtggcggacctgcgcgttcgctcctccacgctgaagggcgtcacggtgccggaagaccgcgcgccttcgatgatcgacgaatatccgattctcgctgtcgccgccgccttcgcggaaggggcgaccgtgatgaacggtctggaagaactccgcgtcaaggaaagcgaccgcctctcggccgtcgccaatggcctcaagctcaatggcgtggattgcgatgagggcgagacgtcgctcgtcgtgcgtggccgccctgacggcaaggggctcggcaacgcctcgggcgccgccgtcgccacccatctcgatcaccgcatcgccatgagcttcctcgtcatgggcctcgtgtcggaaaaccctgtcacggtggacgatgccacgatgatcgccacgagcttcccggagttcatggacctgatggccgggctgggcgcgaagatcgaactctccgatacgaaggctgcctgatgagctcgaattcccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcggggatgggggatccactagtgatatccgtcgactggtacctacgcgtagctagcccgtgaagtttctcatctaagcccccatttggacgtgaatgtagacacgtcgaaataaagatttccgaattagaataatttgtttattgctttcgcctataaatacgacggatcgtaatttgtcgttttatcaaaatgtactttcattttataataacgctgcggacatctacatttttgaattgaaaaaaaattggtaattactctttctttttctccatattgaccatcatactcattgctgatccatgtagatttcccggacatgaagccatttacaattgaatatatcctgccgccgctgccgctttgcacccggtggagcttgcatgttggtttctacgcagaactgagccggttaggcagataatttccattgagaactgagccatgtgcaccttccccccaacacggtgagcgacggggcaacggagtgatccacatgggacttttcctagcttggctgccatttttggggtgaggccgttcgcggccgaggggcgcagcccctggggggatgggaggcccgcgttagcgggccgggagggttcgagaagggggggcaccccccttcggcgtgcgcggtcacgcgcacagggcgcagccctggttaaaaacaaggtttataaatattggtttaaaagcaggttaaaagacaggttagcggtggccgaaaaacgggcggaaacccttgcaaatgctggattttctgcctgtggacagcccctcaaatgtcaataggtgcgcccctcatctgtcagcactctgcccctcaagtgtcaaggatcgcgcccctcatctgtcagtagtcgcgcccctcaagtgtcaataccgcagggcacttatccccaggcttgtccacatcatctgtgggaaactcgcgtaaaatcaggcgttttcgccgatttgcgaggctggccagctccacgtcgccggccgaaatcgagcctgcccctcatctgtcaacgccgcgccgggtgagtcggcccctcaagtgtcaacgtccgcccctcatctgtcagtgagggccaagttttccgcgaggtatccacaacgccggcggccggccgcggtgtctcgcacacggcttcgacggcgtttctggcgcgtttgcagggccatagacggccgccagcccagcggcgagggcaaccagcccggtgagcgtcggaaagggtcgatcgaccgatgcccttgagagccttcaacccagtcagctccttccggtgggcgcggggcatgactatcgtcgccgcacttatgactgtcttctttatcatgcaactcgtaggacaggtgccggcagcgctctgggtcattttcggcgaggaccgctttcgctggagcgcgacgatgatcggcctgtcgcttgcggtattcggaatcttgcacgccctcgctcaagccttcgtcactggtcccgccaccaaacgtttcggcgagaagcaggccattatcgccggcatggcggccgacgcgctgggctacgtcttgctggcgttcgcgacgcgaggctggatggccttccccattatgattcttctcgcttccggcggcatcgggatgcccgcgttgcaggccatgctgtccaggcaggtagatgacgaccatcagggacagcttcaaggatcgctcgcggctcttaccagcctaacttcgatcattggaccgctgatcgtcacggcgatttatgccgcctcggcgagcacatggaacgggttggcatggattgtaggcgccgccctataccttgtctgcctccccgcgttgcgtcgcggtgcatggagccgggccacctcgacctgaatggaagccggcggcacctcgctaacggattcaccactccaagaattggagccaatcaattcttgcggagaactgtgaatgcgcaaaccaacccttggcagaacatatccatcgcgtccgccatctccagcagccgcacgcggcgcatctcgggcagcgttgggtcctggccacgggtgcgcatgatcgtgctcctgtcgttgaggacccggctaggctggcggggttgccttactggttagcagaatgaatcaccgatacgcgagcgaacgtgaagcgactgctgctgcaaaacgtctgcgacctgagcaacaacatgaatggtcttcggtttccgtgtttcgtaaagtctggaaacgcggaagtcagcgccctgcaccattatgttccggatctgcatcgcaggatgctgctggctaccctgtggaacacctacatctgtattaacgaagcgctggcattgaccctgagtgatttttctctggtcccgccgcatccataccgccagttgtttaccctcacaacgttccagtaaccgggcatgttcatcatcagtaacccgtatcgtgagcatcctctctcgtttcatcggtatcattacccccatgaacagaaatcccccttacacggaggcatcagtgaccaaacaggaaaaaaccgcccttaacatggcccgctttatcagaagccagacattaacgcttctggagaaactcaacgagctggacgcggatgaacaggcagacatctgtgaatcgcttcacgaccacgctgatgagctttaccgcagctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcaggtcgggagcacaggatgacgcctaacaattcattcaagccgacaccgcttcgcggcgcggcttaattcaggagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaggtagtcggcaaataatgtctaacaattcgttcaagccgacgccgcttcgcggcgcggcttaactcaagcgttagatgctgcaggcatcgtggtgtcacgctcgtcgtttggtatggcttcattcagctccggttcccaacgatcaaggcgagttacatgatcccccatgttgtgcaaaaaagcggttagctccttcggtcctccgatcgaggatttttcggcgctgcgctacgtccgcgaccgcgttgagggatcaagccacagcagcccactcgaccttctagccgacccagacgagccaagggatctttttggaatgctgctccgtcgtcaggctttccgacgtttgggtggttgaacagaagtcattatcgcacggaatgccaagcactcccgaggggaaccctgtggttggcatgcacatacaaatggacgaacggataaaccttttcacgcccttttaaatatccgattattctaataaacgctcttttctcttaggtttacccgccaatatatcctgtcaaacactgatagtttaaactgaaggcgggaaacgacaatctgg

SEQ ID NO: 30522 - DNA, 9769 bp, Artificial Sequence
  Synthetic DNA construct
ggtccgatgtgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatggtccgattgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagaggaccaggtggtaccggcgcgcctcagcagtcgctgtcgttaacccagcggtactcgctgaggcgatcgcgggccctgatcacctgtcgtacagtatttctacatttgatgtgtgatttgtgaagaacatcaaacaaaacaagcactggctttaatatgatgataagtattatggtaattaattaattggcaaaaacaacaatgaagctaaaattttatttattgagccttgcggttaatttcttgtgatgatctttttttttattttctaattatatatagtttcctttgctttgaaatgctaaaggtttgagagagttatgctctttttttcttcctctttcttttttaactttatcatacaaattttgaataaaaatgtgagtacattgagctcatttaaataagcttgatggggatcagattgtcgtttcccgccttcagtttaaactatcagtgtttgacaggatatattggcgggtaaacctaagagaaaagagcgtttattagaataatcggatatttaaaagggcgtgaaaaggtttatccgttcgtccatttgtatgtgcatgccaaccacagggttcccctcgggagtgcttggcattccgtgcgataatgacttctgttcaaccacccaaacgtcggaaagcctgacgacggagcagcattccaaaaagatcccttggctcgtctgggtcggctagaaggtcgagtgggctgctgtggcttgatccctcaacgcggtcgcggacgtagcgcagcgccgaaaaatcctcgatcggaggaccgaaggagctaaccgcttttttgcacaacatgggggatcatgtaactcgccttgatcgttgggaaccggagctgaatgaagccataccaaacgacgagcgtgacaccacgatgcctgcagcatctaacgcttgagttaagccgcgccgcgaagcggcgtcggcttgaacgaattgttagacattatttgccgactaccttggtgatctcgcctttcacgtagtgaacaaattcttccaactgatctgcgcgcgaggccaagcgatcttcttgtccaagataagcctgcctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatgatgtttaactcctgaattaagccgcgccgcgaagcggtgtcggcttgaatgaattgttaggcgtcatcctgtgctcccgacctgcagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagctgcggtaaagctcatcagcgtggtcgtgaagcgattcacagatgtctgcctgttcatccgcgtccagctcgttgagtttctccagaagcgttaatgtctggcttctgataaagcgggccatgttaagggcggttttttcctgtttggtcactgatgcctccgtgtaagggggatttctgttcatgggggtaatgataccgatgaaacgagagaggatgctcacgatacgggttactgatgatgaacatgcccggttactggaacgttgtgagggtaaacaactggcggtatggatgcggcgggaccagagaaaaatcactcagggtcaatgccagcgcttcgttaatacagatgtaggtgttccacagggtagccagcagcatcctgcgatgcagatccggaacataatggtgcagggcgctgacttccgcgtttccagactttacgaaacacggaaaccgaagaccattcatgttgttgctcaggtcgcagacgttttgcagcagcagtcgcttcacgttcgctcgcgtatcggtgattcattctgctaaccagtaaggcaaccccgccagcctagccgggtcctcaacgacaggagcacgatcatgcgcacccgtggccaggacccaacgctgcccgagatgcgccgcgtgcggctgctggagatggcggacgcgatggatatgttctgccaagggttggtttgcgcattcacagttctccgcaagaattgattggctccaattcttggagtggtgaatccgttagcgaggtgccgccggcttccattcaggtcgaggtggcccggctccatgcaccgcgacgcaacgcggggaggcagacaaggtatagggcggcgcctacaatccatgccaacccgttccatgtgctcgccgaggcggcataaatcgccgtgacgatcagcggtccaatgatcgaagttaggctggtaagagccgcgagcgatccttgaagctgtccctgatggtcgtcatctacctgcctggacagcatggcctgcaacgcgggcatcccgatgccgccggaagcgagaagaatcataatggggaaggccatccagcctcgcgtcgcgaacgccagcaagacgtagcccagcgcgtcggccgccatgccggcgataatggcctgcttctcgccgaaacgtttggtggcgggaccagtgacgaaggcttgagcgagggcgtgcaagattccgaataccgcaagcgacaggccgatcatcgtcgcgctccagcgaaagcggtcctcgccgaaaatgacccagagcgctgccggcacctgtcctacgagttgcatgataaagaagacagtcataagtgcggcgacgatagtcatgccccgcgcccaccggaaggagctgactgggttgaaggctctcaagggcatcggtcgatcgaccctttccgacgctcaccgggctggttgccctcgccgctgggctggcggccgtctatggccctgcaaacgcgccagaaacgccgtcgaagccgtgtgcgagacaccgcggccggccgccggcgttgtggatacctcgcggaaaacttggccctcactgacagatgaggggcggacgttgacacttgaggggccgactcacccggcgcggcgttgacagatgaggggcaggctcgatttcggccggcgacgtggagctggccagcctcgcaaatcggcgaaaacgcctgattttacgcgagtttcccacagatgatgtggacaagcctggggataagtgccctgcggtattgacacttgaggggcgcgactactgacagatgaggggcgcgatccttgacacttgaggggcagagtgctgacagatgaggggcgcacctattgacatttgaggggctgtccacaggcagaaaatccagcatttgcaagggtttccgcccgtttttcggccaccgctaacctgtcttttaacctgcttttaaaccaatatttataaaccttgtttttaaccagggctgcgccctgtgcgcgtgaccgcgcacgccgaaggggggtgcccccccttctcgaaccctcccggcccgctaacgcgggcctcccatccccccaggggctgcgcccctcggccgcgaacggcctcaccccaaaaatggcagccaagctaggaaaagtcccatgtggatcactccgttgccccgtcgctcaccgtgttggggggaaggtgcacatggctcagttctcaatggaaattatctgcctaaccggctcagttctgcgtagaaaccaacatgcaagctccaccgggtgcaaagcggcagcggcggcaggatatattcaattgtaaatggcttcatgtccgggaaatctacatggatcagcaatgagtatgatggtcaatatggagaaaaagaaagagtaattaccaattttttttcaattcaaaaatgtagatgtccgcagcgttattataaaatgaaagtacattttgataaaacgacaaattacgatccgtcgtatttataggcgaaagcaataaacaaattattctaattcggaaatctttatttcgacgtgtctacattcacgtccaaatgggggcttagatgagaaacttcacgatcgatgcggccaccactcgagaagcttactagtcaacaattggccaatctttgttctaaattgctaataaacgaccatttccgtcaattctccttggttgcaacagtctacccgtcaaatgtttactaatttataagtgtgaagtttgaattatgaaagacgaaatcgtattaaaaattcacaagaataaacaactccatagattttcaaaaaaacagtcacgagaaaaaaaccacagtccgtttgtctgctcttctagtttttattatttttctattaatagttttttgttatttcgagaataaaatttgaacgatgtccgaaccacaaaagccgagccgataaatcctaagccgagcctaactttagccgtaaccatcagtcacggctcccgggctaattcatttgaaccgaatcataatcaacggtttagatcaaactcaaaacaatctaacggcaacatagacgcgtcggtgagctaaaaagagtgtgaaagccaggtcaccatagcattgtctctcccagattttttatttgggaaataatagaagaaatagaaaaaaataaaagagtgagaaaaatcgtagagctatatattcgcacatgtactcgtttcgctttccttagtgttagctgctgccgctgttgtttctcctccatttctctatctttctctctcgctgcttctcgaatcttctgtatcatcttcttcttcttcaaggtgagtctctagatccgttcgcttgattttgctgctcgttagtcgttattgttgattctctatgccgatttcgctagatctgtttagcatgcgttgtggttttatgagaaaatctttgttttgggggttgcttgttatgtgattcgatccgtgcttgttggatcgatctgagttaattcttaaggtttatgtgttagatctatggagtttgaggattcttctcgcttctgtcgatctctcgctgttatttttgtttttttcagtgaagtgaagttgtttagttcgaaatgacttcgtgtatgctcgattgatctggttttaatcttcgatctgttaggtgttgatgtttacaagtgaattctagtgttttctcgttgagatctgtgaagtttgaacctagttttctcaataatcaacatatgaagcgatgtttgagtttcaataaacgctgctaatcttcgaaactaagttgtgatctgattcgtgtttacttcatgagcttatccaattcatttcggtttcattttactttttttttagtgaaccatggcgcaagttagcagaatctgcaatggtgtgcagaacccatctcttatctccaatctctcgaaatccagtcaacgcaaatctcccttatcggtttctctgaagacgcagcagcatccacgagcttatccgatttcgtcgtcgtggggattgaagaagagtgggatgacgttaattggctctgagcttcgtcctcttaaggtcatgtcttctgtttccacggcgtgcatgcttcatggagcttcatctaggccagctactgccaggaagtctagcgggctcagtggcaccgtgcgcatccctggcgataaaagtatttcacacaggagcttcatgttcggaggacttgctagtggagagacgagaatcactggtttgcttgagggcgaagatgttatcaacaccggtaaggcgatgcaagcaatgggtgccagaatccgaaaagagggcgatacgtggatcatcgacggtgttggtaacggaggattgctcgctcccgaagcgccacttgactttgggaacgcagctacggggtgccgtcttactatgggactggtaggcgtgtatgactttgactctaccttcatcggtgacgcgagcctcactaagagaccaatgggacgagtgctgaatcccctgagggagatgggtgtccaggtgaaatctgaggatggtgatcgtcttccggttactctgcgaggccccaagacccccacgccaatcacgtacagggttccgatggcgtcagcacaggtcaagtcagcggtactcctggcgggcctcaacacacctggaatcacaaccgtgattgaacccatcatgactagagaccacacggagaagatgttgcagggtttcggcgctaatctaacggtcgaaaccgacgccgacggcgtgaggacaatccgcttggagggcagaggtaaactgactggccaagtcatcgatgtgcctggagatccctcgtccacagcgtttcccctcgtagctgcgttgctcgtccctggatctgatgtgacgatcctgaatgtcctcatgaatccaactagaaccggcctcatcctcacattgcaggagatgggtgctgacatcgaggttatcaatcctaggttggcaggtggagaggatgtggccgatctgcgcgtgcgttctagtacactcaaaggcgtgaccgtccctgaggatcgcgctccatccatgatcgacgagtaccccattctcgccgttgctgctgcgtttgccgagggcgcaactgtaatgaacggccttgaggagttgagggttaaggagagtgacaggctgtccgcggtggcgaatggcctgaagctaaacggcgtggactgcgacgaaggtgaaacgtcccttgtagtccgtggtcgcccagacgggaaggggttggggaatgcttcgggagctgctgtggcgacgcaccttgatcatagaatcgccatgtcatttctggtgatgggacttgtctccgagaatccggtgaccgttgacgatgctaccatgatcgccacctcctttcctgagttcatggacctcatggcaggcttgggggccaagatcgagctgtctgatactaaggccgcttgaattcccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcggggatcccacgtgcggaccgcctgcaggccgcgttatcaagctaactgca

SEQ ID NO: 30523 - DNA, 8504 bp, Artificial Sequence
  Synthetic DNA construct
gtaccctcagcagtcgctgtgcgatcgccagcggtactcgctgaggtcgacgtagttagttaattcagctttcgttcgtatcatcggtttcgacaacgttcgtcaagttcaatgcatcagtttcattgcgcacacaccagaatcctactgagtttgagtattatggcattgggaaaactgtttttcttgtaccatttgttgtgcttgtaatttactgtgttttttattcggttttcgctatcgaactgtgaaatggaaatggatggagaagagttaatgaatgatatggtccttttgttcattctcaaattaatattatttgttttttctcttatttgttgtgtgttgaatttgaaattataagagatatgcaaacattttgttttgagtaaaaatgtgtcaaatcgtggcctctaatgaccgaagttaatatgaggagtaaaacacttgtagttgtaccattatgcttattcactaggcaacaaatatattttcagacctagaaaagctgcaaatgttactgaatacaagtatgtcctcttgtgttttagacatttatgaactttcctttatgtaattttccagaatccttgtcagattctaatcattgctttataattatagttatactcatggatttgtagttgagtatgaaaatattttttaatgcattttatgacttgccaattgattgacaacgcggccgccactcgagtggaagctagctttccgatcctacctgtcacttcatcaaaaggacagtagaaaaggaaggtggcacctacaaatgccatcattgcgataaaggaaaggctatcattcaagatgcctctgccgacagtggtcccaaagatggacccccacccacgaggagcatcgtggaaaaagaagacgttccaaccacgtcttcaaagcaagtggattgatgtgatacttccactgacgtaagggatgacgcacaatcccactatccttcgcaagacccttcctctatataaggaagttcatttcatttggagaggacacgctgaaatcaccagtctctctctacaagatcggggatctctagctagacgatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgatccccaattcccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcggggatcgggccactcgagtggtggccgcatcgatcgtgaagtttctcatctaagcccccatttggacgtgaatgtagacacgtcgaaataaagatttccgaattagaataatttgtttattgctttcgcctataaatacgacggatcgtaatttgtcgttttatcaaaatgtactttcattttataataacgctgcggacatctacatttttgaattgaaaaaaaattggtaattactctttctttttctccatattgaccatcatactcattgctgatccatgtagatttcccggacatgaagccatttacaattgaatatatcctgccgccgctgccgctttgcacccggtggagcttgcatgttggtttctacgcagaactgagccggttaggcagataatttccattgagaactgagccatgtgcaccttccccccaacacggtgagcgacggggcaacggagtgatccacatgggacttttcctagcttggctgccatttttggggtgaggccgttcgcggccgaggggcgcagcccctggggggatgggaggcccgcgttagcgggccgggagggttcgagaagggggggcaccccccttcggcgtgcgcggtcacgcgcacagggcgcagccctggttaaaaacaaggtttataaatattggtttaaaagcaggttaaaagacaggttagcggtggccgaaaaacgggcggaaacccttgcaaatgctggattttctgcctgtggacagcccctcaaatgtcaataggtgcgcccctcatctgtcagcactctgcccctcaagtgtcaaggatcgcgcccctcatctgtcagtagtcgcgcccctcaagtgtcaataccgcagggcacttatccccaggcttgtccacatcatctgtgggaaactcgcgtaaaatcaggcgttttcgccgatttgcgaggctggccagctccacgtcgccggccgaaatcgagcctgcccctcatctgtcaacgccgcgccgggtgagtcggcccctcaagtgtcaacgtccgcccctcatctgtcagtgagggccaagttttccgcgaggtatccacaacgccggcggccggccgcggtgtctcgcacacggcttcgacggcgtttctggcgcgtttgcagggccatagacggccgccagcccagcggcgagggcaaccagcccggtgagcgtcggaaagggtcgatcgaccgatgcccttgagagccttcaacccagtcagctccttccggtgggcgcggggcatgactatcgtcgccgcacttatgactgtcttctttatcatgcaactcgtaggacaggtgccggcagcgctctgggtcattttcggcgaggaccgctttcgctggagcgcgacgatgatcggcctgtcgcttgcggtattcggaatcttgcacgccctcgctcaagccttcgtcactggtcccgccaccaaacgtttcggcgagaagcaggccattatcgccggcatggcggccgacgcgctgggctacgtcttgctggcgttcgcgacgcgaggctggatggccttccccattatgattcttctcgcttccggcggcatcgggatgcccgcgttgcaggccatgctgtccaggcaggtagatgacgaccatcagggacagcttcaaggatcgctcgcggctcttaccagcctaacttcgatcattggaccgctgatcgtcacggcgatttatgccgcctcggcgagcacatggaacgggttggcatggattgtaggcgccgccctataccttgtctgcctccccgcgttgcgtcgcggtgcatggagccgggccacctcgacctgaatggaagccggcggcacctcgctaacggattcaccactccaagaattggagccaatcaattcttgcggagaactgtgaatgcgcaaaccaacccttggcagaacatatccatcgcgtccgccatctccagcagccgcacgcggcgcatctcgggcagcgttgggtcctggccacgggtgcgcatgatcgtgctcctgtcgttgaggacccggctaggctggcggggttgccttactggttagcagaatgaatcaccgatacgcgagcgaacgtgaagcgactgctgctgcaaaacgtctgcgacctgagcaacaacatgaatggtcttcggtttccgtgtttcgtaaagtctggaaacgcggaagtcagcgccctgcaccattatgttccggatctgcatcgcaggatgctgctggctaccctgtggaacacctacatctgtattaacgaagcgctggcattgaccctgagtgatttttctctggtcccgccgcatccataccgccagttgtttaccctcacaacgttccagtaaccgggcatgttcatcatcagtaacccgtatcgtgagcatcctctctcgtttcatcggtatcattacccccatgaacagaaatcccccttacacggaggcatcagtgaccaaacaggaaaaaaccgcccttaacatggcccgctttatcagaagccagacattaacgcttctggagaaactcaacgagctggacgcggatgaacaggcagacatctgtgaatcgcttcacgaccacgctgatgagctttaccgcagctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcaggtcgggagcacaggatgacgcctaacaattcattcaagccgacaccgcttcgcggcgcggcttaattcaggagttaaacatcatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgagattctccgcgctgtagaagtcaccattgttgtgcacgacgacatcattccgtggcgttatccagctaagcgcgaactgcaatttggagaatggcagcgcaatgacattcttgcaggtatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctaggcaggcttatcttggacaagaagatcgcttggcctcgcgcgcagatcagttggaagaatttgttcactacgtgaaaggcgagatcaccaaggtagtcggcaaataatgtctaacaattcgttcaagccgacgccgcttcgcggcgcggcttaactcaagcgttagatgctgcaggcatcgtggtgtcacgctcgtcgtttggtatggcttcattcagctccggttcccaacgatcaaggcgagttacatgatcccccatgttgtgcaaaaaagcggttagctccttcggtcctccgatcgaggatttttcggcgctgcgctacgtccgcgaccgcgttgagggatcaagccacagcagcccactcgaccttctagccgacccagacgagccaagggatctttttggaatgctgctccgtcgtcaggctttccgacgtttgggtggttgaacagaagtcattatcgcacggaatgccaagcactcccgaggggaaccctgtggttggcatgcacatacaaatggacgaacggataaaccttttcacgcccttttaaatatccgattattctaataaacgctcttttctcttaggtttacccgccaatatatcctgtcaaacactgatagtttaaactgaaggcgggaaacgacaatctgatccccatcaagcttggccagcttctgcaggtccgattgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatggtccgattgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagaggacacagaaaaatttgctacattgtttcacaaacttcaaatattattcatttatttgtcagctttcaaactctttgtttcttgtttgttgattagatctg

SEQ ID NO: 30524 - DNA, 828 bp, Glycine max
ggcaaaaacatttaatacgtattatttaagaaaaaaatatgtaataatatatttatattttaatatctattcttatgtattttttaaaaatctattatatattgatcaactaaaatatttttatatctacacttattttgcatttttatcaattttcttgcgttttttggcatatttaataatgactattctttaataatcaatcattattcttacatggtacatattgttggaaccatatgaagtgtccattgcatttgactatgtggatagtgttttgatccaggcctccatttgccgcttattaattaatttggtaacagtccgtactaatcagttacttatccttcctccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagcccacacatttgttgtttctaacccaacctcaaactcgtattctcttccgccacctcatttttgtttatttcaacacccgtcaaactgcatgccaccccgtggccaaatgtccatgcatgttaacaagacctatgactataaatatctgcaatctcggcccaggttttc

SEQ ID NO: 30525 - DNA, 13 bp, Glycine max
atcatcaagaacc

SEQ ID NO: 30526 - protein, 485 aa, Artificial Sequence
  Synthetic consensus sequence
  misc_feature (1)..(171): Xaa can be any naturally occurring amino acid
  misc_feature (173)..(176): Xaa can be any naturally occurring amino acid
  misc_feature (179)..(179): Xaa can be any naturally occurring amino acid
  misc_feature (183)..(184): Xaa can be any naturally occurring amino acid
  misc_feature (186)..(187): Xaa can be any naturally occurring amino acid
  misc_feature (189)..(191): Xaa can be any naturally occurring amino acid
  misc_feature (193)..(194): Xaa can be any naturally occurring amino acid
  misc_feature (196)..(198): Xaa can be any naturally occurring amino acid
  misc_feature (202)..(208): Xaa can be any naturally occurring amino acid
  misc_feature (211)..(211): Xaa can be any naturally occurring amino acid
  misc_feature (214)..(215): Xaa can be any naturally occurring amino acid
  misc_feature (218)..(219): Xaa can be any naturally occurring amino acid
  misc_feature (221)..(222): Xaa can be any naturally occurring amino acid
  misc_feature (225)..(229): Xaa can be any naturally occurring amino acid
  misc_feature (231)..(231): Xaa can be any naturally occurring amino acid
  misc_feature (234)..(259): Xaa can be any naturally occurring amino acid
  misc_feature (261)..(263): Xaa can be any naturally occurring amino acid
  misc_feature (266)..(267): Xaa can be any naturally occurring amino acid
  misc_feature (269)..(271): Xaa can be any naturally occurring amino acid
  misc_feature (273)..(279): Xaa can be any naturally occurring amino acid
  misc_feature (281)..(284): Xaa can be any naturally occurring amino acid
  misc_feature (287)..(292): Xaa can be any naturally occurring amino acid
  misc_feature (295)..(315): Xaa can be any naturally occurring amino acid
  misc_feature (317)..(318): Xaa can be any naturally occurring amino acid
  misc_feature (320)..(325): Xaa can be any naturally occurring amino acid
  misc_feature (327)..(327): Xaa can be any naturally occurring amino acid
  misc_feature (329)..(331): Xaa can be any naturally occurring amino acid
  misc_feature (333)..(334): Xaa can be any naturally occurring amino acid
  misc_feature (336)..(345): Xaa can be any naturally occurring amino acid
  misc_feature (347)..(351): Xaa can be any naturally occurring amino acid
  misc_feature (353)..(354): Xaa can be any naturally occurring amino acid
  misc_feature (356)..(360): Xaa can be any naturally occurring amino acid
  misc_feature (363)..(365): Xaa can be any naturally occurring amino acid
  misc_feature (367)..(367): Xaa can be any naturally occurring amino acid
  misc_feature (369)..(369): Xaa can be any naturally occurring amino acid
  misc_feature (372)..(374): Xaa can be any naturally occurring amino acid
  misc_feature (376)..(382): Xaa can be any naturally occurring amino acid
  misc_feature (385)..(387): Xaa can be any naturally occurring amino acid
  misc_feature (392)..(394): Xaa can be any naturally occurring amino acid
  misc_feature (396)..(397): Xaa can be any naturally occurring amino acid
  misc_feature (399)..(401): Xaa can be any naturally occurring amino acid
  misc_feature (403)..(403): Xaa can be any naturally occurring amino acid
  misc_feature (405)..(405): Xaa can be any naturally occurring amino acid
  misc_feature (407)..(407): Xaa can be any naturally occurring amino acid
  misc_feature (411)..(443): Xaa can be any naturally occurring amino acid
  misc_feature (447)..(485): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXIXXXXPTXASAXXNXXPXXXFXXAXXXRMEXXXXXXXSSXAKXXGTXXSXXGAXXXXXYXGPXXXXXXXXXXXXXXXXXXXXXXXXXXSXXXDWXXGXXXLXXXXXXXSXXXXLQXXXXXXYPXXXXXXXXXXXXXXXXXXXXXLXXEXXXXXXWXIXXXIXXLXXXXXXXXXXSXXXXXIXXWXXXXXGPXXXAXFXPLXXXIXXXXXXXFLXXXLYLGXXXGXXLXXXGXYXVXWGKXXXXXXXXXXXXXXXXXXXXXXXXXXXXXXXXXPLLXXXXXXXXXXXXXXXXXXXXXXXXXXXXXXXXXXXXXXX

SEQ ID NO: 30527 - protein, 387 aa, Artificial Sequence
  Synthetic consensus sequence
  misc_feature (1)..(58): Xaa can be any naturally occurring amino acid
  misc_feature (91)..(93): Xaa can be any naturally occurring amino acid
  misc_feature (140)..(141): Xaa can be any naturally occurring amino acid
  misc_feature (159)..(159): Xaa can be any naturally occurring amino acid
  misc_feature (164)..(164): Xaa can be any naturally occurring amino acid
XXXXXXXXXXXXXXXXXXXXXXXXXXXXXXXXXXXXXXXXXXXXXXXXXXXXXXXXXXMKLDHVDSTADITKQHEKENTHDHPNANPNPNXXXHPHPHPQLTKTTSSRSKTSRHGTPSVRSESSCNSQTFLMRINNHNEXXQRKMNDTSISFGGFRCYXPCSGXKTVHTDPKNSCKSRNSDRDFVAYDARKHNDKPRLHFEAKKADFHAQEKISLPIQRSDIAMNLERKLSLLTWDAIPNQLSTKNNNHNNNGNNSSMSSNTQEEETASVASSDLFEIENITSSVYEPSEASIGWSVVTGSMADQSVISDFDMMKRVTRNGPVVKTKPVIGEKVRSAGFLSGCKSHKAVSVVDSSRKVKETAKVDHHEMSHQKKFKTEIRIQDLSFL

SEQ ID NO: 30528 - protein, 826 aa, Artificial Sequence
  Synthetic consensus sequence
  misc_feature (1)..(578): Xaa can be any naturally occurring amino acid
  misc_feature (580)..(584): Xaa can be any naturally occurring amino acid
  misc_feature (586)..(617): Xaa can be any naturally occurring amino acid
  misc_feature (619)..(643): Xaa can be any naturally occurring amino acid
  misc_feature (646)..(649): Xaa can be any naturally occurring amino acid
  misc_feature (651)..(652): Xaa can be any naturally occurring amino acid
  misc_feature (654)..(655): Xaa can be any naturally occurring amino acid
  misc_feature (658)..(659): Xaa can be any naturally occurring amino acid
  misc_feature (661)..(684): Xaa can be any naturally occurring amino acid
  misc_feature (686)..(695): Xaa can be any naturally occurring amino acid
  misc_feature (697)..(704): Xaa can be any naturally occurring amino acid
  misc_feature (707)..(707): Xaa can be any naturally occurring amino acid
  misc_feature (709)..(709): Xaa can be any naturally occurring amino acid
  misc_feature (712)..(715): Xaa can be any naturally occurring amino acid
  misc_feature (718)..(718): Xaa can be any naturally occurring amino acid
  misc_feature (720)..(724): Xaa can be any naturally occurring amino acid
  misc_feature (726)..(728): Xaa can be any naturally occurring amino acid
  misc_feature (731)..(732): Xaa can be any naturally occurring amino acid
  misc_feature (735)..(736): Xaa can be any naturally occurring amino acid
  misc_feature (739)..(746): Xaa can be any naturally occurring amino acid
  misc_feature (748)..(748): Xaa can be any naturally occurring amino acid
  misc_feature (750)..(750): Xaa can be any naturally occurring amino acid
  misc_feature (752)..(753): Xaa can be any naturally occurring amino acid
  misc_feature (756)..(757): Xaa can be any naturally occurring amino acid
  misc_feature (759)..(761): Xaa can be any naturally occurring amino acid
  misc_feature (763)..(820): Xaa can be any naturally occurring amino acid
  misc_feature (823)..(826): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEXXXXXLXXXXXXXXXXXXXXXXXXXXXXXXXXXXXXXXGXXXXXXXXXXXXXXXXXXXXXXXXXHFXXXXFXXCXXMDXXLXXXXXXXXXXXXXXXXXXXXXXXXAXXXXXXXXXXFXXXXXXXXPFXVXKLXXXXLPXVXXXXXGXXXDRXXGFXXLGXXXXXXXXDXFXTXXLEXXLXXXGXXXXXXXXXXXXXXXXXXXXXXXXXXXXXXXXXXXXXXXXXXXXXXXXXXXXXXXXXXDSXXXX

SEQ ID NO: 30529 - protein, 249 aa, Artificial Sequence
  Synthetic consensus sequence
  misc_feature (1)..(110): Xaa can be any naturally occurring amino acid
  misc_feature (112)..(115): Xaa can be any naturally occurring amino acid
  misc_feature (117)..(118): Xaa can be any naturally occurring amino acid
  misc_feature (120)..(120): Xaa can be any naturally occurring amino acid
  misc_feature (123)..(123): Xaa can be any naturally occurring amino acid
  misc_feature (126)..(127): Xaa can be any naturally occurring amino acid
  misc_feature (132)..(133): Xaa can be any naturally occurring amino acid
  misc_feature (136)..(136): Xaa can be any naturally occurring amino acid
  misc_feature (139)..(140): Xaa can be any naturally occurring amino acid
  misc_feature (154)..(154): Xaa can be any naturally occurring amino acid
  misc_feature (159)..(159): Xaa can be any naturally occurring amino acid
  misc_feature (161)..(161): Xaa can be any naturally occurring amino acid
  misc_feature (169)..(169): Xaa can be any naturally occurring amino acid
  misc_feature (176)..(176): Xaa can be any naturally occurring amino acid
  misc_feature (178)..(178): Xaa can be any naturally occurring amino acid
  misc_feature (180)..(180): Xaa can be any naturally occurring amino acid
  misc_feature (182)..(184): Xaa can be any naturally occurring amino acid
  misc_feature (186)..(188): Xaa can be any naturally occurring amino acid
  misc_feature (191)..(192): Xaa can be any naturally occurring amino acid
  misc_feature (195)..(195): Xaa can be any naturally occurring amino acid
  misc_feature (201)..(209): Xaa can be any naturally occurring amino acid
  misc_feature (212)..(212): Xaa can be any naturally occurring amino acid
  misc_feature (215)..(218): Xaa can be any naturally occurring amino acid
  misc_feature (220)..(220): Xaa can be any naturally occurring amino acid
  misc_feature (224)..(224): Xaa can be any naturally occurring amino acid
  misc_feature (231)..(231): Xaa can be any naturally occurring amino acid
  misc_feature (238)..(239): Xaa can be any naturally occurring amino acid
  misc_feature (246)..(248): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGXXXXDXXFXKQXGKXXLCTYXXFGXAWXXNETSPLGWWTLKPXPKEEXEXAHLYERRXFPYPGDXEXAXEXXXFXXXGGXXGTXIGPKGXXXXXXXXXDNXQKXXXXKXKFDXEAQKLWXRMRNEVXXELQEKGXXXE

SEQ ID NO: 30530 - protein, 102 aa, Artificial Sequence
  Synthetic consensus sequence
  misc_feature (1)..(1): Xaa can be any naturally occurring amino acid
  misc_feature (4)..(4): Xaa can be any naturally occurring amino acid
  misc_feature (7)..(8): Xaa can be any naturally occurring amino acid
  misc_feature (13)..(17): Xaa can be any naturally occurring amino acid
  misc_feature (20)..(20): Xaa can be any naturally occurring amino acid
  misc_feature (22)..(22): Xaa can be any naturally occurring amino acid
  misc_feature (25)..(25): Xaa can be any naturally occurring amino acid
  misc_feature (32)..(33): Xaa can be any naturally occurring amino acid
  misc_feature (35)..(35): Xaa can be any naturally occurring amino acid
  misc_feature (38)..(38): Xaa can be any naturally occurring amino acid
  misc_feature (40)..(41): Xaa can be any naturally occurring amino acid
  misc_feature (43)..(44): Xaa can be any naturally occurring amino acid
  misc_feature (46)..(46): Xaa can be any naturally occurring amino acid
  misc_feature (48)..(49): Xaa can be any naturally occurring amino acid
  misc_feature (51)..(51): Xaa can be any naturally occurring amino acid
  misc_feature (62)..(62): Xaa can be any naturally occurring amino acid
  misc_feature (72)..(72): Xaa can be any naturally occurring amino acid
  misc_feature (76)..(76): Xaa can be any naturally occurring amino acid
  misc_feature (79)..(81): Xaa can be any naturally occurring amino acid
  misc_feature (83)..(89): Xaa can be any naturally occurring amino acid
  misc_feature (91)..(92): Xaa can be any naturally occurring amino acid
  misc_feature (95)..(95): Xaa can be any naturally occurring amino acid
  misc_feature (101)..(102): Xaa can be any naturally occurring amino acid
XMSXRRXXRSRQXXXXXRIXDXQIXDLVSKLXXLXPEXRXXRXXDXVXXSXVLQETCNYIRXLHREVDDLSXRLSXLLXXXDXXXXXXXSXXAAXIRSLLXX

SEQ ID NO: 30531 - protein, 354 aa, Artificial Sequence
  Synthetic consensus sequence
  misc_feature (1)..(128): Xaa can be any naturally occurring amino acid
  misc_feature (130)..(134): Xaa can be any naturally occurring amino acid
  misc_feature (136)..(136): Xaa can be any naturally occurring amino acid
  misc_feature (138)..(140): Xaa can be any naturally occurring amino acid
  misc_feature (143)..(150): Xaa can be any naturally occurring amino acid
  misc_feature (152)..(153): Xaa can be any naturally occurring amino acid
  misc_feature (156)..(156): Xaa can be any naturally occurring amino acid
  misc_feature (181)..(182): Xaa can be any naturally occurring amino acid
  misc_feature (184)..(185): Xaa can be any naturally occurring amino acid
  misc_feature (192)..(192): Xaa can be any naturally occurring amino acid
  misc_feature (199)..(200): Xaa can be any naturally occurring amino acid
  misc_feature (202)..(202): Xaa can be any naturally occurring amino acid
  misc_feature (205)..(205): Xaa can be any naturally occurring amino acid
  misc_feature (211)..(211): Xaa can be any naturally occurring amino acid
  misc_feature (213)..(214): Xaa can be any naturally occurring amino acid
  misc_feature (220)..(220): Xaa can be any naturally occurring amino acid
  misc_feature (227)..(229): Xaa can be any naturally occurring amino acid
  misc_feature (234)..(234): Xaa can be any naturally occurring amino acid
  misc_feature (236)..(236): Xaa can be any naturally occurring amino acid
  misc_feature (239)..(239): Xaa can be any naturally occurring amino acid
  misc_feature (241)..(242): Xaa can be any naturally occurring amino acid
  misc_feature (245)..(245): Xaa can be any naturally occurring amino acid
  misc_feature (260)..(260): Xaa can be any naturally occurring amino acid
  misc_feature (264)..(264): Xaa can be any naturally occurring amino acid
  misc_feature (267)..(267): Xaa can be any naturally occurring amino acid
  misc_feature (271)..(271): Xaa can be any naturally occurring amino acid
  misc_feature (273)..(273): Xaa can be any naturally occurring amino acid
  misc_feature (279)..(291): Xaa can be any naturally occurring amino acid
  misc_feature (300)..(300): Xaa can be any naturally occurring amino acid
  misc_feature (302)..(302): Xaa can be any naturally occurring amino acid
  misc_feature (304)..(308): Xaa can be any naturally occurring amino acid
  misc_feature (317)..(318): Xaa can be any naturally occurring amino acid
  misc_feature (322)..(323): Xaa can be any naturally occurring amino acid
  misc_feature (339)..(339): Xaa can be any naturally occurring amino acid
  misc_feature (346)..(346): Xaa can be any naturally occurring amino acid
  misc_feature (350)..(351): Xaa can be any naturally occurring amino acid
  misc_feature (353)..(353): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXDXXXXXDXYXXXDDXXXXXXXXEXXLYXGDGGAGGGISLAGTWWDKEALALAXXVXXSFDGDLXIYAFKTXXNXTIXVRIEKXSXXYGSPTXDDIEAFXXXYRAKXDXAEXAXXIPXNISLEVSSPGVERVXRIPXDLXRFKXRXMYVRYXXXXXXXXXXXXXEGDGVFRLXSXDXXXXXCTWGIADVXXNRQXXGKGRPLSKKQREWRLXTPFESLXLVRXXSXC

SEQ ID NO: 30532 - protein, 348 aa, Artificial Sequence
  Synthetic consensus sequence
  misc_feature (1)..(40): Xaa can be any naturally occurring amino acid
  misc_feature (42)..(42): Xaa can be any naturally occurring amino acid
  misc_feature (44)..(44): Xaa can be any naturally occurring amino acid
  misc_feature (48)..(48): Xaa can be any naturally occurring amino acid
  misc_feature (51)..(51): Xaa can be any naturally occurring amino acid
  misc_feature (56)..(61): Xaa can be any naturally occurring amino acid
  misc_feature (65)..(65): Xaa can be any naturally occurring amino acid
  misc_feature (68)..(73): Xaa can be any naturally occurring amino acid
  misc_feature (75)..(80): Xaa can be any naturally occurring amino acid
  misc_feature (82)..(95): Xaa can be any naturally occurring amino acid
  misc_feature (97)..(99): Xaa can be any naturally occurring amino acid
  misc_feature (103)..(103): Xaa can be any naturally occurring amino acid
  misc_feature (106)..(106): Xaa can be any naturally occurring amino acid
  misc_feature (108)..(108): Xaa can be any naturally occurring amino acid
  misc_feature (110)..(110): Xaa can be any naturally occurring amino acid
  misc_feature (112)..(114): Xaa can be any naturally occurring amino acid
  misc_feature (117)..(117): Xaa can be any naturally occurring amino acid
  misc_feature (120)..(120): Xaa can be any naturally occurring amino acid
  misc_feature (122)..(122): Xaa can be any naturally occurring amino acid
  misc_feature (127)..(127): Xaa can be any naturally occurring amino acid
  misc_feature (136)..(136): Xaa can be any naturally occurring amino acid
  misc_feature (139)..(139): Xaa can be any naturally occurring amino acid
  misc_feature (141)..(144): Xaa can be any naturally occurring amino acid
  misc_feature (146)..(146): Xaa can be any naturally occurring amino acid
  misc_feature (148)..(148): Xaa can be any naturally occurring amino acid
  misc_feature (150)..(150): Xaa can be any naturally occurring amino acid
  misc_feature (156)..(156): Xaa can be any naturally occurring amino acid
  misc_feature (160)..(160): Xaa can be any naturally occurring amino acid
  misc_feature (170)..(171): Xaa can be any naturally occurring amino acid
  misc_feature (176)..(176): Xaa can be any naturally occurring amino acid
  misc_feature (179)..(180): Xaa can be any naturally occurring amino acid
  misc_feature (183)..(191): Xaa can be any naturally occurring amino acid
  misc_feature (193)..(193): Xaa can be any naturally occurring amino acid
  misc_feature (195)..(209): Xaa can be any naturally occurring amino acid
  misc_feature (215)..(215): Xaa can be any naturally occurring amino acid
  misc_feature (219)..(219): Xaa can be any naturally occurring amino acid
  misc_feature (221)..(222): Xaa can be any naturally occurring amino acid
  misc_feature (224)..(235): Xaa can be any naturally occurring amino acid
  misc_feature (241)..(243): Xaa can be any naturally occurring amino acid
  misc_feature (246)..(254): Xaa can be any naturally occurring amino acid
  misc_feature (256)..(257): Xaa can be any naturally occurring amino acid
  misc_feature (260)..(261): Xaa can be any naturally occurring amino acid
  misc_feature (263)..(264): Xaa can be any naturally occurring amino acid
  misc_feature (266)..(269): Xaa can be any naturally occurring amino acid
  misc_feature (271)..(272): Xaa can be any naturally occurring amino acid
  misc_feature (274)..(276): Xaa can be any naturally occurring amino acid
  misc_feature (278)..(284): Xaa can be any naturally occurring amino acid
  misc_feature (287)..(287): Xaa can be any naturally occurring amino acid
  misc_feature (289)..(291): Xaa can be any naturally occurring amino acid
  misc_feature (293)..(293): Xaa can be any naturally occurring amino acid
  misc_feature (296)..(298): Xaa can be any naturally occurring amino acid
  misc_feature (300)..(348): Xaa can be any naturally occurring amino acid
XXXXXXXXXXXXXXXXXXXXXXXXXXXXXXXXXXXXXXXXYXLXEHPXIVXFRWSXXXXXXSTWXFLXXXXXXYXXXXXXLXXXXXXXXXXXXXXRXXXLGPXPAXHXLXMXXXSAXIFXGXLLSAXAEIRDTRWXWRXRXXXXTXLXWXLLCFPXGTRXSGRVFFWSYXXYLSRXLHXXRTXXXXXXXXXRXLXXXXXXXXXXXXXXXFLWLEXSQSXQXXAXXXXXXXXXXXXGYRFWXXXGLXXXXXXXXXVXXCQXXLXXCXXXXHXXVXXXHXXXXXXXGCXGXXXWXFNXXXNXXXXXXXXXXXXXXXXXXXXXXXXXXXXXXXXXXXXXXXXXXXXXXXXX

SEQ ID NO: 30533 - protein, 98 aa, Artificial Sequence
  Synthetic consensus sequence
  misc_feature (3)..(3): Xaa can be any naturally occurring amino acid
  misc_feature (5)..(7): Xaa can be any naturally occurring amino acid
  misc_feature (10)..(10): Xaa can be any naturally occurring amino acid
  misc_feature (13)..(17): Xaa can be any naturally occurring amino acid
  misc_feature (20)..(20): Xaa can be any naturally occurring amino acid
  misc_feature (22)..(22): Xaa can be any naturally occurring amino acid
  misc_feature (25)..(25): Xaa can be any naturally occurring amino acid
  misc_feature (32)..(33): Xaa can be any naturally occurring amino acid
  misc_feature (35)..(35): Xaa can be any naturally occurring amino acid
  misc_feature (38)..(41): Xaa can be any naturally occurring amino acid
  misc_feature (43)..(44): Xaa can be any naturally occurring amino acid
  misc_feature (46)..(46): Xaa can be any naturally occurring amino acid
  misc_feature (51)..(51): Xaa can be any naturally occurring amino acid
  misc_feature (62)..(62): Xaa can be any naturally occurring amino acid
  misc_feature (72)..(72): Xaa can be any naturally occurring amino acid
  misc_feature (76)..(76): Xaa can be any naturally occurring amino acid
  misc_feature (79)..(81): Xaa can be any naturally occurring amino acid
  misc_feature (83)..(84): Xaa can be any naturally occurring amino acid
  misc_feature (86)..(87): Xaa can be any naturally occurring amino acid
  misc_feature (90)..(90): Xaa can be any naturally occurring amino acid
  misc_feature (96)..(98): Xaa can be any naturally occurring amino acid
MSXRXXXRSXRQXXXXXRIXDXQIXDLVSKLXXLXPEXXXXRXXDXVSASXVLQETCNYIRXLHREVDDLSXRLSXLLXXXDXXSXXAAXIRSLLXXX

SEQ ID NO: 30534 - protein, 1038 aa, Artificial Sequence
  Synthetic consensus sequence
  misc_feature (1)..(775): Xaa can be any naturally occurring amino acid
  misc_feature (778)..(784): Xaa can be any naturally occurring amino acid
  misc_feature (788)..(788): Xaa can be any naturally occurring amino acid
  misc_feature (790)..(790): Xaa can be any naturally occurring amino acid
  misc_feature (800)..(800): Xaa can be any naturally occurring amino acid
  misc_feature (803)..(803): Xaa can be any naturally occurring amino acid
  misc_feature (805)..(806): Xaa can be any naturally occurring amino acid
  misc_feature (810)..(811): Xaa can be any naturally occurring amino acid
  misc_feature (815)..(815): Xaa can be any naturally occurring amino acid
  misc_feature (820)..(824): Xaa can be any naturally occurring amino acid
  misc_feature (828)..(828): Xaa can be any naturally occurring amino acid
  misc_feature (830)..(831): Xaa can be any naturally occurring amino acid
  misc_feature (844)..(844): Xaa can be any naturally occurring amino acid
  misc_feature (846)..(846): Xaa can be any naturally occurring amino acid
  misc_feature (856)..(856): Xaa can be any naturally occurring amino acid
  misc_feature (859)..(859): Xaa can be any naturally occurring amino acid
  misc_feature (861)..(861): Xaa can be any naturally occurring amino acid
  misc_feature (864)..(864): Xaa can be any naturally occurring amino acid
  misc_feature (892)..(892): Xaa can be any naturally occurring amino acid
  misc_feature (897)..(897): Xaa can be any naturally occurring amino acid
  misc_feature (904)..(904): Xaa can be any naturally occurring amino acid
  misc_feature (907)..(907): Xaa can be any naturally occurring amino acid
  misc_feature (916)..(1038): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXMAXXXXXXXRKPXFXKVDQLRPGTXGHXLXXKVVXXKMVXQKGRXXXXXGPQXRXXRIAECLVGDETGXIXFTARNDQVDXMKXGXTVXLRNAKIDMFKGSMRLAVDKWGRVEVTEXPASFXVKEDNNXSLXEYELVNVVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 30535 - protein, 569 aa, Artificial Sequence
  Synthetic consensus sequence
  misc_feature (1)..(17): Xaa can be any naturally occurring amino acid
  misc_feature (19)..(36): Xaa can be any naturally occurring amino acid
  misc_feature (39)..(39): Xaa can be any naturally occurring amino acid
  misc_feature (42)..(42): Xaa can be any naturally occurring amino acid
  misc_feature (46)..(46): Xaa can be any naturally occurring amino acid
  misc_feature (48)..(48): Xaa can be any naturally occurring amino acid
  misc_feature (51)..(51): Xaa can be any naturally occurring amino acid
  misc_feature (54)..(54): Xaa can be any naturally occurring amino acid
  misc_feature (59)..(59): Xaa can be any naturally occurring amino acid
  misc_feature (61)..(63): Xaa can be any naturally occurring amino acid
  misc_feature (65)..(66): Xaa can be any naturally occurring amino acid
  misc_feature (68)..(90): Xaa can be any naturally occurring amino acid
  misc_feature (92)..(94): Xaa can be any naturally occurring amino acid
  misc_feature (96)..(113): Xaa can be any naturally occurring amino acid
  misc_feature (115)..(117): Xaa can be any naturally occurring amino acid
  misc_feature (119)..(569): Xaa can be any naturally occurring amino acid
XXXXXXXXXXXXXXXXXKXXXXXXXXXXXXXXXXXXLQXLRXYCQXCXKQXRDXNGFKXHXXXSXXHXXXXXXXXXXXXXXXXXXXXXXXFXXXFXXXXXXXXXXXXXXXXXXYXXXIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 30536 - protein, 210 aa, Artificial Sequence
  Synthetic consensus sequence
  misc_feature (1)..(3): Xaa can be any naturally occurring amino acid
  misc_feature (5)..(5): Xaa can be any naturally occurring amino acid
  misc_feature (7)..(21): Xaa can be any naturally occurring amino acid
  misc_feature (24)..(40): Xaa can be any naturally occurring amino acid
  misc_feature (47)..(49): Xaa can be any naturally occurring amino acid
  misc_feature (51)..(55): Xaa can be any naturally occurring amino acid
  misc_feature (61)..(61): Xaa can be any naturally occurring amino acid
  misc_feature (64)..(66): Xaa can be any naturally occurring amino acid
  misc_feature (76)..(76): Xaa can be any naturally occurring amino acid
  misc_feature (88)..(88): Xaa can be any naturally occurring amino acid
  misc_feature (93)..(109): Xaa can be any naturally occurring amino acid
  misc_feature (111)..(111): Xaa can be any naturally occurring amino acid
  misc_feature (113)..(113): Xaa can be any naturally occurring amino acid
  misc_feature (116)..(116): Xaa can be any naturally occurring amino acid
  misc_feature (118)..(118): Xaa can be any naturally occurring amino acid
  misc_feature (120)..(120): Xaa can be any naturally occurring amino acid
  misc_feature (122)..(122): Xaa can be any naturally occurring amino acid
  misc_feature (124)..(127): Xaa can be any naturally occurring amino acid
  misc_feature (131)..(168): Xaa can be any naturally occurring amino acid
  misc_feature (170)..(210): Xaa can be any naturally occurring amino acid
XXXMXNXXXXXXXXXXXXXXXCAXXXXXXXXXXXXXXXXXSCICCCXXXNXXXXXQARSQXGSXXXKGKVHPVSRXEKWEEKITEANXHGKIXXXXXXXXXXXXXXXXXFXAXWCXPXKXIXPXXXXLASXXXXXXXXXXXXXXXXXXXXXXXXXXXXXXXXXXXXXXVXXXXXXXXXXXXXXXXXXXXXXXXXXXXXXXXXXXXXXXXX

SEQ ID NO: 30537 - protein, 191 aa, Artificial Sequence
  Synthetic consensus sequence
  misc_feature (1)..(53): Xaa can be any naturally occurring amino acid
  misc_feature (59)..(60): Xaa can be any naturally occurring amino acid
  misc_feature (67)..(67): Xaa can be any naturally occurring amino acid
  misc_feature (69)..(70): Xaa can be any naturally occurring amino acid
  misc_feature (85)..(85): Xaa can be any naturally occurring amino acid
  misc_feature (87)..(108): Xaa can be any naturally occurring amino acid
  misc_feature (112)..(113): Xaa can be any naturally occurring amino acid
  misc_feature (115)..(115): Xaa can be any naturally occurring amino acid
  misc_feature (117)..(117): Xaa can be any naturally occurring amino acid
  misc_feature (126)..(126): Xaa can be any naturally occurring amino acid
  misc_feature (128)..(128): Xaa can be any naturally occurring amino acid
  misc_feature (138)..(138): Xaa can be any naturally occurring amino acid
  misc_feature (142)..(149): Xaa can be any naturally occurring amino acid
  misc_feature (158)..(158): Xaa can be any naturally occurring amino acid
  misc_feature (160)..(160): Xaa can be any naturally occurring amino acid
  misc_feature (163)..(163): Xaa can be any naturally occurring amino acid
  misc_feature (165)..(165): Xaa can be any naturally occurring amino acid
  misc_feature (168)..(168): Xaa can be any naturally occurring amino acid
  misc_feature (170)..(170): Xaa can be any naturally occurring amino acid
  misc_feature (172)..(191): Xaa can be any naturally occurring amino acid
XXXXXXXXXXXXXXXXXXXXXXXXXXXXXXXXXXXXXXXXXXXXXXXXXXXXXMPSLQXXLPPELAXNXXRLYRECLRRAKFIGXQXXXXXXXXXXXXXXXXXXXXXXHNTXXLXVXMVRQQFKKXMXETDPEKIQKXKDDXXXXXXXXAARGLINHXLXESXKXTGXKXSXXXXXXXXXXXXXXXXXXXX

SEQ ID NO: 30538 - protein, 598 aa, Artificial Sequence
  Synthetic consensus sequence
  misc_feature (1)..(29): Xaa can be any naturally occurring amino acid
  misc_feature (33)..(44): Xaa can be any naturally occurring amino acid
  misc_feature (46)..(71): Xaa can be any naturally occurring amino acid
  misc_feature (73)..(95): Xaa can be any naturally occurring amino acid
  misc_feature (97)..(115): Xaa can be any naturally occurring amino acid
  misc_feature (120)..(120): Xaa can be any naturally occurring amino acid
  misc_feature (124)..(124): Xaa can be any naturally occurring amino acid
  misc_feature (148)..(148): Xaa can be any naturally occurring amino acid
  misc_feature (150)..(150): Xaa can be any naturally occurring amino acid
  misc_feature (152)..(152): Xaa can be any naturally occurring amino acid
  misc_feature (164)..(164): Xaa can be any naturally occurring amino acid
  misc_feature (167)..(169): Xaa can be any naturally occurring amino acid
  misc_feature (171)..(171): Xaa can be any naturally occurring amino acid
  misc_feature (176)..(176): Xaa can be any naturally occurring amino acid
  misc_feature (180)..(180): Xaa can be any naturally occurring amino acid
  misc_feature (184)..(184): Xaa can be any naturally occurring amino acid
  misc_feature (186)..(186): Xaa can be any naturally occurring amino acid
  misc_feature (190)..(192): Xaa can be any naturally occurring amino acid
  misc_feature (195)..(195): Xaa can be any naturally occurring amino acid
  misc_feature (198)..(198): Xaa can be any naturally occurring amino acid
  misc_feature (202)..(203): Xaa can be any naturally occurring amino acid
  misc_feature (207)..(207): Xaa can be any naturally occurring amino acid
  misc_feature (215)..(215): Xaa can be any naturally occurring amino acid
  misc_feature (217)..(221): Xaa can be any naturally occurring amino acid
  misc_feature (224)..(269): Xaa can be any naturally occurring amino acid
  misc_feature (271)..(271): Xaa can be any naturally occurring amino acid
  misc_feature (275)..(275): Xaa can be any naturally occurring amino acid
  misc_feature (280)..(280): Xaa can be any naturally occurring amino acid
  misc_feature (287)..(287): Xaa can be any naturally occurring amino acid
  misc_feature (289)..(290): Xaa can be any naturally occurring amino acid
  misc_feature (293)..(293): Xaa can be any naturally occurring amino acid
  misc_feature (296)..(301): Xaa can be any naturally occurring amino acid
  misc_feature (303)..(306): Xaa can be any naturally occurring amino acid
  misc_feature (308)..(308): Xaa can be any naturally occurring amino acid
  misc_feature (310)..(311): Xaa can be any naturally occurring amino acid
  misc_feature (313)..(314): Xaa can be any naturally occurring amino acid
  misc_feature (317)..(322): Xaa can be any naturally occurring amino acid
  misc_feature (324)..(331): Xaa can be any naturally occurring amino acid
  misc_feature (334)..(339): Xaa can be any naturally occurring amino acid
  misc_feature (341)..(341): Xaa can be any naturally occurring amino acid
  misc_feature (343)..(343): Xaa can be any naturally occurring amino acid
  misc_feature (345)..(346): Xaa can be any naturally occurring amino acid
  misc_feature (349)..(358): Xaa can be any naturally occurring amino acid
  misc_feature (360)..(371): Xaa can be any naturally occurring amino acid
  misc_feature (374)..(374): Xaa can be any naturally occurring amino acid
  misc_feature (376)..(376): Xaa can be any naturally occurring amino acid
  misc_feature (381)..(382): Xaa can be any naturally occurring amino acid
  misc_feature (386)..(386): Xaa can be any naturally occurring amino acid
  misc_feature (389)..(389): Xaa can be any naturally occurring amino acid
  misc_feature (395)..(397): Xaa can be any naturally occurring amino acid
  misc_feature (399)..(399): Xaa can be any naturally occurring amino acid
  misc_feature (401)..(401): Xaa can be any naturally occurring amino acid
  misc_feature (406)..(422): Xaa can be any naturally occurring amino acid
  misc_feature (424)..(475): Xaa can be any naturally occurring amino acid
  misc_feature (477)..(479): Xaa can be any naturally occurring amino acid
  misc_feature (481)..(481): Xaa can be any naturally occurring amino acid
  misc_feature (484)..(484): Xaa can be any naturally occurring amino acid
  misc_feature (486)..(598): Xaa can be any naturally occurring amino acid
XXXXXXXXXXXXXXXXXXXXXXXXXXXXXMGKXXXXXXXXXXXXRXXXXXXXXXXXXXXXXXXXXXXXXXXDXXXXXXXXXXXXXXXXXXXXXXXEXXXXXXXXXXXXXXXXXXXPSKFXLYQXSVQSPKGDISYLQKFFLMYVGGRXPXHXQEDFCGTALLSXEWXXXDXRRTAXGLDXDLEXLXEWCXXXNNXSKXGADXXSRMXLFHGNVLXPXXXXXVKXXXXXXXXXXXXXXXXXXXXXXXXXXXXXXXXXXXXXXXXXXXXXXPXRDIXCAFNXSCCCLHXRXXLVXYFXXXXXXLXXXXGXFXXDXXGGXXXXXXLXXXXXXXXFTXXXXXXYXWXQXXFDXXXXXXXXXXHXXXXXXXXXXXXAFXYXWRLWXXPEIXDCXEEAGFXXXHXWXREMPXXXXXXXXXXXXXXXXXKXXXXXXXXXXXXXXXXXXXXXXXXXXXXXXXXXXXXXXXXXXXXXXXXXXXXQXXXWXAYXVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 30539 - protein, 494 aa, Artificial Sequence
  Synthetic consensus sequence
  misc_feature (4)..(9): Xaa can be any naturally occurring amino acid
  misc_feature (12)..(13): Xaa can be any naturally occurring amino acid
  misc_feature (16)..(16): Xaa can be any naturally occurring amino acid
  misc_feature (18)..(35): Xaa can be any naturally occurring amino acid
  misc_feature (37)..(63): Xaa can be any naturally occurring amino acid
  misc_feature (69)..(72): Xaa can be any naturally occurring amino acid
  misc_feature (75)..(75): Xaa can be any naturally occurring amino acid
  misc_feature (82)..(84): Xaa can be any naturally occurring amino acid
  misc_feature (88)..(88): Xaa can be any naturally occurring amino acid
  misc_feature (93)..(93): Xaa can be any naturally occurring amino acid
  misc_feature (97)..(98): Xaa can be any naturally occurring amino acid
  misc_feature (100)..(100): Xaa can be any naturally occurring amino acid
  misc_feature (102)..(103): Xaa can be any naturally occurring amino acid
  misc_feature (105)..(109): Xaa can be any naturally occurring amino acid
  misc_feature (111)..(140): Xaa can be any naturally occurring amino acid
  misc_feature (142)..(210): Xaa can be any naturally occurring amino acid
  misc_feature (212)..(224): Xaa can be any naturally occurring amino acid
  misc_feature (226)..(232): Xaa can be any naturally occurring amino acid
  misc_feature (234)..(261): Xaa can be any naturally occurring amino acid
  misc_feature (263)..(265): Xaa can be any naturally occurring amino acid
  misc_feature (271)..(272): Xaa can be any naturally occurring amino acid
  misc_feature (274)..(274): Xaa can be any naturally occurring amino acid
  misc_feature (276)..(276): Xaa can be any naturally occurring amino acid
  misc_feature (278)..(281): Xaa can be any naturally occurring amino acid
  misc_feature (284)..(290): Xaa can be any naturally occurring amino acid
  misc_feature (294)..(294): Xaa can be any naturally occurring amino acid
  misc_feature (304)..(304): Xaa can be any naturally occurring amino acid
  misc_feature (306)..(306): Xaa can be any naturally occurring amino acid
  misc_feature (308)..(308): Xaa can be any naturally occurring amino acid
  misc_feature (311)..(311): Xaa can be any naturally occurring amino acid
  misc_feature (314)..(315): Xaa can be any naturally occurring amino acid
  misc_feature (317)..(318): Xaa can be any naturally occurring amino acid
  misc_feature (320)..(321): Xaa can be any naturally occurring amino acid
  misc_feature (323)..(325): Xaa can be any naturally occurring amino acid
  misc_feature (327)..(332): Xaa can be any naturally occurring amino acid
  misc_feature (335)..(352): Xaa can be any naturally occurring amino acid
  misc_feature (355)..(356): Xaa can be any naturally occurring amino acid
  misc_feature (358)..(363): Xaa can be any naturally occurring amino acid
  misc_feature (365)..(370): Xaa can be any naturally occurring amino acid
  misc_feature (372)..(372): Xaa can be any naturally occurring amino acid
  misc_feature (374)..(374): Xaa can be any naturally occurring amino acid
  misc_feature (379)..(379): Xaa can be any naturally occurring amino acid
  misc_feature (383)..(387): Xaa can be any naturally occurring amino acid
  misc_feature (393)..(393): Xaa can be any naturally occurring amino acid
  misc_feature (399)..(400): Xaa can be any naturally occurring amino acid
  misc_feature (404)..(405): Xaa can be any naturally occurring amino acid
  misc_feature (419)..(420): Xaa can be any naturally occurring amino acid
  misc_feature (422)..(446): Xaa can be any naturally occurring amino acid
  misc_feature (448)..(461): Xaa can be any naturally occurring amino acid
  misc_feature (463)..(468): Xaa can be any naturally occurring amino acid
  misc_feature (472)..(494): Xaa can be any naturally occurring amino acid
MPTXXXXXXLDXXLEXGXXXXXXXXXXXXXXXXXXPXXXXXXXXXXXXXXXXXXXXXXXXXXXLYATPXXXXLPXSPSSFPXXXSPYXINHKXRGPXXLXKXXSXXXXXSXXXXXXXXXXXXXXXXXXXXXXXXXXXXXXFXXXXXXXXXXXXXXXXXXXXXXXXXXXXXXXXXXXXXXXXXXXXXXXXXXXXXXXXXXXXXXXXXXXXXPXXXXXXXXXXXXXFXXXXXXXSXXXXXXXXXXXXXXXXXXXXXXXXXXXXTXXXEFYDAXXEXSXDXXXXSSXXXXXXXLREXRLSLLMEIEXRXQXEEXLEXXQXXWXXLXXXLXXXXXXLPXXXXXXXXXXXXXXXXXXELXXQXXXXXXVXXXXXXGXAXAEVEXEMEXXXXXKNFEIXRLSDRXXYYEXXNREMSQRNQEAIEXXRXXXXXXXXXXXXXXXXXXXXXXXXXRXXXXXXXXXXXXXXLXXXXXXWSYXXXXXXXXXXXXXXXXXXXXXXX

SEQ ID NO: 30540 - protein, 229 aa, Artificial Sequence
  Synthetic consensus sequence
  misc_feature (1)..(145): Xaa can be any naturally occurring amino acid
  misc_feature (149)..(149): Xaa can be any naturally occurring amino acid
  misc_feature (151)..(154): Xaa can be any naturally occurring amino acid
  misc_feature (156)..(157): Xaa can be any naturally occurring amino acid
  misc_feature (160)..(160): Xaa can be any naturally occurring amino acid
  misc_feature (168)..(168): Xaa can be any naturally occurring amino acid
  misc_feature (177)..(178): Xaa can be any naturally occurring amino acid
  misc_feature (182)..(182): Xaa can be any naturally occurring amino acid
  misc_feature (184)..(188): Xaa can be any naturally occurring amino acid
  misc_feature (191)..(192): Xaa can be any naturally occurring amino acid
  misc_feature (198)..(229): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXYFSXEXXXXLXXLTXSLLILPLXLPPLPPPPXXLLLXPXXXXXLLXXLAFMPXXXXXXXXXXXXXXXXXXXXXXXXXXXXXXXX

SEQ ID NO: 30541 - protein, 95 aa, Artificial Sequence
  Synthetic consensus sequence
  misc_feature (3)..(7): Xaa can be any naturally occurring amino acid
  misc_feature (9)..(14): Xaa can be any naturally occurring amino acid
  misc_feature (17)..(17): Xaa can be any naturally occurring amino acid
  misc_feature (19)..(19): Xaa can be any naturally occurring amino acid
  misc_feature (30)..(30): Xaa can be any naturally occurring amino acid
  misc_feature (40)..(40): Xaa can be any naturally occurring amino acid
  misc_feature (42)..(43): Xaa can be any naturally occurring amino acid
  misc_feature (46)..(46): Xaa can be any naturally occurring amino acid
  misc_feature (56)..(56): Xaa can be any naturally occurring amino acid
  misc_feature (70)..(70): Xaa can be any naturally occurring amino acid
  misc_feature (74)..(74): Xaa can be any naturally occurring amino acid
  misc_feature (77)..(77): Xaa can be any naturally occurring amino acid
  misc_feature (79)..(79): Xaa can be any naturally occurring amino acid
  misc_feature (81)..(82): Xaa can be any naturally occurring amino acid
  misc_feature (87)..(87): Xaa can be any naturally occurring amino acid
  misc_feature (95)..(95): Xaa can be any naturally occurring amino acid
MSXXXXXGXXXXXXRIXDXEINELISKLQXLLPESSRRRXAXXRSXASKLLKETCXYIKSLHREVDDLSXRLSXLMXTXDXXSPQAXIIRSLLRX

SEQ ID NO: 30542 - protein, 117 aa, Artificial Sequence
  Synthetic consensus sequence
  misc_feature (3)..(7): Xaa can be any naturally occurring amino acid
  misc_feature (9)..(22): Xaa can be any naturally occurring amino acid
  misc_feature (25)..(25): Xaa can be any naturally occurring amino acid
  misc_feature (27)..(27): Xaa can be any naturally occurring amino acid
  misc_feature (29)..(37): Xaa can be any naturally occurring amino acid
  misc_feature (39)..(40): Xaa can be any naturally occurring amino acid
  misc_feature (46)..(47): Xaa can be any naturally occurring amino acid
  misc_feature (49)..(49): Xaa can be any naturally occurring amino acid
  misc_feature (52)..(55): Xaa can be any naturally occurring amino acid
  misc_feature (57)..(61): Xaa can be any naturally occurring amino acid
  misc_feature (63)..(66): Xaa can be any naturally occurring amino acid
  misc_feature (73)..(73): Xaa can be any naturally occurring amino acid
  misc_feature (77)..(77): Xaa can be any naturally occurring amino acid
  misc_feature (87)..(87): Xaa can be any naturally occurring amino acid
  misc_feature (91)..(91): Xaa can be any naturally occurring amino acid
  misc_feature (94)..(96): Xaa can be any naturally occurring amino acid
  misc_feature (98)..(99): Xaa can be any naturally occurring amino acid
  misc_feature (101)..(107): Xaa can be any naturally occurring amino acid
  misc_feature (109)..(110): Xaa can be any naturally occurring amino acid
  misc_feature (116)..(117): Xaa can be any naturally occurring amino acid
MSXXXXXRXXXXXXXXXXXXXXRIXDXQXXXXXXXXXIXXLVSKLXXLXPEXXXXRXXXXXVXXXXVLQETCXYIRXLHREVDDLSXRLSXLLXXXDXXSXXXXXXXAXXIRSLLXX

SEQ ID NO: 30543 - protein, 117 aa, Artificial Sequence; identical to SEQ ID NO: 30542
  Synthetic consensus sequence
  misc_feature (3)..(7): Xaa can be any naturally occurring amino acid
  misc_feature (9)..(22): Xaa can be any naturally occurring amino acid
  misc_feature (25)..(25): Xaa can be any naturally occurring amino acid
  misc_feature (27)..(27): Xaa can be any naturally occurring amino acid
  misc_feature (29)..(37): Xaa can be any naturally occurring amino acid
  misc_feature (39)..(40): Xaa can be any naturally occurring amino acid
  misc_feature (46)..(47): Xaa can be any naturally occurring amino acid
  misc_feature (49)..(49): Xaa can be any naturally occurring amino acid
  misc_feature (52)..(55): Xaa can be any naturally occurring amino acid
  misc_feature (57)..(61): Xaa can be any naturally occurring amino acid
  misc_feature (63)..(66): Xaa can be any naturally occurring amino acid
  misc_feature (73)..(73): Xaa can be any naturally occurring amino acid
  misc_feature (77)..(77): Xaa can be any naturally occurring amino acid
  misc_feature (87)..(87): Xaa can be any naturally occurring amino acid
  misc_feature (91)..(91): Xaa can be any naturally occurring amino acid
  misc_feature (94)..(96): Xaa can be any naturally occurring amino acid
  misc_feature (98)..(99): Xaa can be any naturally occurring amino acid
  misc_feature (101)..(107): Xaa can be any naturally occurring amino acid
  misc_feature (109)..(110): Xaa can be any naturally occurring amino acid
  misc_feature (116)..(117): Xaa can be any naturally occurring amino acid

SEQ ID NO: 30544 - protein, 1705 aa, Artificial Sequence
  Synthetic consensus sequence
  misc_feature (1)..(303): Xaa can be any naturally occurring amino acid
  misc_feature (305)..(305): Xaa can be any naturally occurring amino acid
  misc_feature (307)..(317): Xaa can be any naturally occurring amino acid
  misc_feature (320)..(333): Xaa can be any naturally occurring amino acid
  misc_feature (336)..(350): Xaa can be any naturally occurring amino acid
  misc_feature (352)..(354): Xaa can be any naturally occurring amino acid
  misc_feature (356)..(358): Xaa can be any naturally occurring amino acid
  misc_feature (360)..(369): Xaa can be any naturally occurring amino acid
  misc_feature (373)..(374): Xaa can be any naturally occurring amino acid
  misc_feature (376)..(384): Xaa can be any naturally occurring amino acid
  misc_feature (387)..(395): Xaa can be any naturally occurring amino acid
  misc_feature (397)..(397): Xaa can be any naturally occurring amino acid
  misc_feature (400)..(400): Xaa can be any naturally occurring amino acid
  misc_feature (402)..(405): Xaa can be any naturally occurring amino acid
  misc_feature (407)..(474): Xaa can be any naturally occurring amino acid
  misc_feature (477)..(479): Xaa can be any naturally occurring amino acid
  misc_feature (481)..(489): Xaa can be any naturally occurring amino acid
  misc_feature (491)..(491): Xaa can be any naturally occurring amino acid
  misc_feature (494)..(496): Xaa can be any naturally occurring amino acid
  misc_feature (498)..(528): Xaa can be any naturally occurring amino acid
  misc_feature (530)..(534): Xaa can be any naturally occurring amino acid
  misc_feature (536)..(573): Xaa can be any naturally occurring amino acid
  misc_feature (575)..(593): Xaa can be any naturally occurring amino acid
  misc_feature (595)..(724): Xaa can be any naturally occurring amino acid
  misc_feature (726)..(729): Xaa can be any naturally occurring amino acid
  misc_feature (731)..(733): Xaa can be any naturally occurring amino acid
  misc_feature (735)..(740): Xaa can be any naturally occurring amino acid
  misc_feature (742)..(991): Xaa can be any naturally occurring amino acid
  misc_feature (993)..(1023): Xaa can be any naturally occurring amino acid
  misc_feature (1025)..(1029): Xaa can be any naturally occurring amino acid
  misc_feature (1031)..(1263): Xaa can be any naturally occurring amino acid
  misc_feature (1265)..(1267): Xaa can be any naturally occurring amino acid
  misc_feature (1269)..(1270): Xaa can be any naturally occurring amino acid
  misc_feature (1272)..(1278): Xaa can be any naturally occurring amino acid
  misc_feature (1280)..(1281): Xaa can be any naturally occurring amino acid
  misc_feature (1284)..(1705): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGXQXXXXXXXXXXXLQXXXXXXXXXXXXXXLGXXXXXXXXXXXXXXXWXXXPXXXGXXXXXXXXXXVQPXXGXXXXXXXXXSDXXXXXXXXXGXRRXPXXXXGXXXXXXXXXXXXXXXXXXXXXXXXXXXXXXXXXXXXXXXXXXXXXXXXXXXXXXXXXXXXXXXXXXXXLDXXXNXXXXXXXXXPXRAXXXDXXXXXXXXXXXXXXXXXXXXXXXXXXXXXXXSXXXXXGXXXXXXXXXXXXXXXXXXXXXXXXXXXXXXXXXXXXXXFXXXXXXXXXXXXXXXXXXXEXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVXXXXWXXXFXXXXXXTXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGXXXXXXXXXXXXXXXXXXXXXXXXXXXXXXXAXXXXXPXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGXXXGXXNXXXXXXXIXXPQXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 30545 - protein, 168 aa, Artificial Sequence
  Synthetic consensus sequence
  misc_feature (1)..(33): Xaa can be any naturally occurring amino acid
  misc_feature (37)..(37): Xaa can be any naturally occurring amino acid
  misc_feature (39)..(41): Xaa can be any naturally occurring amino acid
  misc_feature (43)..(44): Xaa can be any naturally occurring amino acid
  misc_feature (46)..(48): Xaa can be any naturally occurring amino acid
  misc_feature (54)..(55): Xaa can be any naturally occurring amino acid
  misc_feature (60)..(60): Xaa can be any naturally occurring amino acid
  misc_feature (62)..(62): Xaa can be any naturally occurring amino acid
  misc_feature (66)..(71): Xaa can be any naturally occurring amino acid
  misc_feature (73)..(73): Xaa can be any naturally occurring amino acid
  misc_feature (78)..(78): Xaa can be any naturally occurring amino acid
  misc_feature (82)..(82): Xaa can be any naturally occurring amino acid
  misc_feature (85)..(86): Xaa can be any naturally occurring amino acid
  misc_feature (88)..(88): Xaa can be any naturally occurring amino acid
  misc_feature (91)..(95): Xaa can be any naturally occurring amino acid
  misc_feature (99)..(101): Xaa can be any naturally occurring amino acid
  misc_feature (103)..(103): Xaa can be any naturally occurring amino acid
  misc_feature (106)..(106): Xaa can be any naturally occurring amino acid
  misc_feature (108)..(109): Xaa can be any naturally occurring amino acid
  misc_feature (111)..(119): Xaa can be any naturally occurring amino acid
  misc_feature (121)..(124): Xaa can be any naturally occurring amino acid
  misc_feature (127)..(127): Xaa can be any naturally occurring amino acid
  misc_feature (131)..(138): Xaa can be any naturally occurring amino acid
  misc_feature (140)..(141): Xaa can be any naturally occurring amino acid
  misc_feature (143)..(145): Xaa can be any naturally occurring amino acid
  misc_feature (147)..(147): Xaa can be any naturally occurring amino acid
  misc_feature (149)..(163): Xaa can be any naturally occurring amino acid
  misc_feature (165)..(165): Xaa can be any naturally occurring amino acid
  misc_feature (167)..(167): Xaa can be any naturally occurring amino acid
XXXXXXXXXXXXXXXXXXXXXXXXXXXXXXXXXMAKXNXXXKXXRXXXADRKRXXHGDPXTXKLKXXXXXXSXSGKRXRKLXRKXXRXQKXXXXXKGLXXXMXDVXMXXAXXXXXXXXXKXXXXKFXVKKXXXXXXXXLXXKXXXKXKXXXXXXXXXXXXXXXDXMXE

SEQ ID NO: 30546 - protein, 168 aa, Artificial Sequence
  Synthetic consensus sequence
  misc_feature (1)..(33): Xaa can be any naturally occurring amino acid
  misc_feature (37)..(37): Xaa can be any naturally occurring amino acid
  misc_feature (39)..(41): Xaa can be any naturally occurring amino acid
  misc_feature (43)..(44): Xaa can be any naturally occurring amino acid
  misc_feature (46)..(48): Xaa can be any naturally occurring amino acid
  misc_feature (50)..(51): Xaa can be any naturally occurring amino acid
  misc_feature (54)..(55): Xaa can be any naturally occurring amino acid
  misc_feature (60)..(60): Xaa can be any naturally occurring amino acid
  misc_feature (62)..(62): Xaa can be any naturally occurring amino acid
  misc_feature (66)..(71): Xaa can be any naturally occurring amino acid
  misc_feature (73)..(73): Xaa can be any naturally occurring amino acid
  misc_feature (78)..(78): Xaa can be any naturally occurring amino acid
  misc_feature (82)..(83): Xaa can be any naturally occurring amino acid
  misc_feature (85)..(86): Xaa can be any naturally occurring amino acid
  misc_feature (88)..(88): Xaa can be any naturally occurring amino acid
  misc_feature (91)..(95): Xaa can be any naturally occurring amino acid
  misc_feature (99)..(101): Xaa can be any naturally occurring amino acid
  misc_feature (103)..(103): Xaa can be any naturally occurring amino acid
  misc_feature (106)..(106): Xaa can be any naturally occurring amino acid
  misc_feature (108)..(109): Xaa can be any naturally occurring amino acid
  misc_feature (111)..(124): Xaa can be any naturally occurring amino acid
  misc_feature (127)..(128): Xaa can be any naturally occurring amino acid
  misc_feature (131)..(138): Xaa can be any naturally occurring amino acid
  misc_feature (140)..(141): Xaa can be any naturally occurring amino acid
  misc_feature (143)..(145): Xaa can be any naturally occurring amino acid
  misc_feature (147)..(147): Xaa can be any naturally occurring amino acid
  misc_feature (149)..(163): Xaa can be any naturally occurring amino acid
  misc_feature (165)..(165): Xaa can be any naturally occurring amino acid
  misc_feature (167)..(167): Xaa can be any naturally occurring amino acid
XXXXXXXXXXXXXXXXXXXXXXXXXXXXXXXXXMAKXNXXXKXXRXXXAXXKRXXHGDPXTXKLKXXXXXXSXSGKRXRKLXXKXXRXQKXXXXXKGLXXXMXDVXMXXAXXXXXXXXXXXXXXKFXXKKXXXXXXXXLXXKXXXKXKXXXXXXXXXXXXXXXDXMXE

SEQ ID NO: 30547 - protein, 1404 aa, Artificial Sequence
  Synthetic consensus sequence
  misc_feature (1)..(1284): Xaa can be any naturally occurring amino acid
  misc_feature (1286)..(1290): Xaa can be any naturally occurring amino acid
  misc_feature (1292)..(1293): Xaa can be any naturally occurring amino acid
  misc_feature (1296)..(1325): Xaa can be any naturally occurring amino acid
  misc_feature (1327)..(1336): Xaa can be any naturally occurring amino acid
  misc_feature (1338)..(1338): Xaa can be any naturally occurring amino acid
  misc_feature (1347)..(1347): Xaa can be any naturally occurring amino acid
  misc_feature (1350)..(1350): Xaa can be any naturally occurring amino acid
  misc_feature (1356)..(1356): Xaa can be any naturally occurring amino acid
  misc_feature (1364)..(1364): Xaa can be any naturally occurring amino acid
  misc_feature (1371)..(1371): Xaa can be any naturally occurring amino acid
  misc_feature (1375)..(1375): Xaa can be any naturally occurring amino acid
  misc_feature (1386)..(1404): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXNXXXXXAXXEAXXXXXXXXXXXXXXXXXXXXXXXXXXXXXXPXXXXXXXXXXLXEENQKLKEXLQXLLASGXDQMGVITXLSEKVKXLERXLARKKRPKVRXXXXXXXXXXXXXXXXXXX

SEQ ID NO: 30548 - protein, 720 aa, Artificial Sequence
  Synthetic consensus sequence
  misc_feature (4)..(5): Xaa can be any naturally occurring amino acid
  misc_feature (14)..(14): Xaa can be any naturally occurring amino acid
  misc_feature (32)..(32): Xaa can be any naturally occurring amino acid
  misc_feature (35)..(35): Xaa can be any naturally occurring amino acid
  misc_feature (60)..(61): Xaa can be any naturally occurring amino acid
  misc_feature (66)..(66): Xaa can be any naturally occurring amino acid
  misc_feature (72)..(72): Xaa can be any naturally occurring amino acid
  misc_feature (80)..(81): Xaa can be any naturally occurring amino acid
  misc_feature (84)..(85): Xaa can be any naturally occurring amino acid
  misc_feature (87)..(88): Xaa can be any naturally occurring amino acid
  misc_feature (91)..(92): Xaa can be any naturally occurring amino acid
  misc_feature (94)..(94): Xaa can be any naturally occurring amino acid
  misc_feature (97)..(97): Xaa can be any naturally occurring amino acid
  misc_feature (127)..(127): Xaa can be any naturally occurring amino acid
  misc_feature (159)..(159): Xaa can be any naturally occurring amino acid
  misc_feature (162)..(162): Xaa can be any naturally occurring amino acid
  misc_feature (171)..(171): Xaa can be any naturally occurring amino acid
  misc_feature (173)..(173): Xaa can be any naturally occurring amino acid
  misc_feature (176)..(176): Xaa can be any naturally occurring amino acid
  misc_feature (179)..(179): Xaa can be any naturally occurring amino acid
  misc_feature (181)..(182): Xaa can be any naturally occurring amino acid
  misc_feature (188)..(191): Xaa can be any naturally occurring amino acid
  misc_feature (197)..(197): Xaa can be any naturally occurring amino acid
  misc_feature (203)..(203): Xaa can be any naturally occurring amino acid
  misc_feature (209)..(209): Xaa can be any naturally occurring amino acid
  misc_feature (218)..(218): Xaa can be any naturally occurring amino acid
  misc_feature (223)..(223): Xaa can be any naturally occurring amino acid
  misc_feature (225)..(225): Xaa can be any naturally occurring amino acid
  misc_feature (258)..(258): Xaa can be any naturally occurring amino acid
  misc_feature (266)..(274): Xaa can be any naturally occurring amino acid
  misc_feature (280)..(283): Xaa can be any naturally occurring amino acid
  misc_feature (285)..(286): Xaa can be any naturally occurring amino acid
  misc_feature (288)..(293): Xaa can be any naturally occurring amino acid
  misc_feature (295)..(295): Xaa can be any naturally occurring amino acid
  misc_feature (306)..(342): Xaa can be any naturally occurring amino acid
  misc_feature (350)..(350): Xaa can be any naturally occurring amino acid
  misc_feature (352)..(385): Xaa can be any naturally occurring amino acid
  misc_feature (387)..(387): Xaa can be any naturally occurring amino acid
  misc_feature (390)..(393): Xaa can be any naturally occurring amino acid
  misc_feature (413)..(424): Xaa can be any naturally occurring amino acid
  misc_feature (426)..(480): Xaa can be any naturally occurring amino acid
  misc_feature (482)..(484): Xaa can be any naturally occurring amino acid
  misc_feature (490)..(524): Xaa can be any naturally occurring amino acid
  misc_feature (528)..(528): Xaa can be any naturally occurring amino acid
  misc_feature (542)..(542): Xaa can be any naturally occurring amino acid
  misc_feature (555)..(555): Xaa can be any naturally occurring amino acid
  misc_feature (557)..(558): Xaa can be any naturally occurring amino acid
  misc_feature (562)..(563): Xaa can be any naturally occurring amino acid
  misc_feature (565)..(569): Xaa can be any naturally occurring amino acid
  misc_feature (573)..(576): Xaa can be any naturally occurring amino acid
  misc_feature (579)..(579): Xaa can be any naturally occurring amino acid
  misc_feature (602)..(602): Xaa can be any naturally occurring amino acid
  misc_feature (609)..(610): Xaa can be any naturally occurring amino acid
  misc_feature (612)..(612): Xaa can be any naturally occurring amino acid
  misc_feature (614)..(614): Xaa can be any naturally occurring amino acid
  misc_feature (621)..(621): Xaa can be any naturally occurring amino acid
  misc_feature (628)..(628): Xaa can be any naturally occurring amino acid
  misc_feature (631)..(631): Xaa can be any naturally occurring amino acid
  misc_feature (636)..(636): Xaa can be any naturally occurring amino acid
  misc_feature (638)..(638): Xaa can be any naturally occurring amino acid
  misc_feature (640)..(642): Xaa can be any naturally occurring amino acid
  misc_feature (645)..(645): Xaa can be any naturally occurring amino acid
  misc_feature (663)..(663): Xaa can be any naturally occurring amino acid
  misc_feature (667)..(667): Xaa can be any naturally occurring amino acid
  misc_feature (672)..(672): Xaa can be any naturally occurring amino acid
  misc_feature (686)..(686): Xaa can be any naturally occurring amino acid
  misc_feature (691)..(691): Xaa can be any naturally occurring amino acid
  misc_feature (693)..(720): Xaa can be any naturally occurring amino acid
MITXXDFYHVMTAXVPLYVAMILAYGSVKWWXIFXPDQCSGINRFVALFAVPLLSFHFIXXNNPYXMNLRFXAADTLQKXXVLXXLXXWSXXSXRGXLEWTITLFSLSTLPNTLVMGIPLLKGMYGXFSGSLMVQIVVLQCIIWYTLMLFMFEYRGARXLIXEQFPDTAGXIXSIXVDXDXXSLDGRXXXXETEAEXKEDGKXHVTVRXSNASRSDIXSRRSXGXSSTTPRPSNLTNAEIYSLQSSRNPTPRGSSFNXHTDFYSMXXXXXXXXXSNFGAXXXXDXXGXXXXXXGXTPRPSNYEEDXXXXXXXXXXXXXXXXXXXXXXXXXXXXXXXXXXXXXHYPAPNPXMXXXXXXXXXXXXXXXXXXXXXXXXXXXXXXXXXXKXEDXXXXDLHMFVWSSSASPVSDVFGXXXXXXXXXXXXKXXXXXXXXXXXXXXXXXXXXXXXXXXXXXXXXXXXXXXXXXXXXXXXXXXXXXXXEXXXFSFGNXXXXXXXXXXXXXXXXXXXXXXXXXXXXXXXXXXXMPPXSVMTRLILIMVWRXKLIRNPNTYSSLXGXXWSLXXFXXXXXMPAXXXXSIXILSDAGLGMAMFSLGLFMALQPXIIACGNXXAXFXMAVRFLXGPAVMAXASXAVGLXGXLXXXAIXQAALPQGIVPFVFAKEYXVHPXILSTXVIFGMLIALPITLXYYILXGXXXXXXXXXXXXXXXXXXXXXXXXXXXX

SEQ ID NO: 30549 - protein, 179 aa, Artificial Sequence
  Synthetic consensus sequence
  misc_feature (1)..(12): Xaa can be any naturally occurring amino acid
  misc_feature (14)..(39): Xaa can be any naturally occurring amino acid
  misc_feature (41)..(59): Xaa can be any naturally occurring amino acid
  misc_feature (65)..(67): Xaa can be any naturally occurring amino acid
  misc_feature (80)..(80): Xaa can be any naturally occurring amino acid
  misc_feature (83)..(83): Xaa can be any naturally occurring amino acid
  misc_feature (86)..(86): Xaa can be any naturally occurring amino acid
  misc_feature (90)..(96): Xaa can be any naturally occurring amino acid
  misc_feature (99)..(100): Xaa can be any naturally occurring amino acid
  misc_feature (104)..(104): Xaa can be any naturally occurring amino acid
  misc_feature (115)..(115): Xaa can be any naturally occurring amino acid
  misc_feature (127)..(127): Xaa can be any naturally occurring amino acid
  misc_feature (140)..(140): Xaa can be any naturally occurring amino acid
  misc_feature (146)..(146): Xaa can be any naturally occurring amino acid
  misc_feature (149)..(149): Xaa can be any naturally occurring amino acid
  misc_feature (154)..(154): Xaa can be any naturally occurring amino acid
  misc_feature (159)..(159): Xaa can be any naturally occurring amino acid
  misc_feature (164)..(164): Xaa can be any naturally occurring amino acid
  misc_feature (166)..(170): Xaa can be any naturally occurring amino acid
  misc_feature (174)..(176): Xaa can be any naturally occurring amino acid
  misc_feature (178)..(178): Xaa can be any naturally occurring amino acid
XXXXXXXXXXXXSXXXXXXXXXXXXXXXXXXXXXXXXXXRXXXXXXXXXXXXXXXXXXXKQSLFXXXTEALDFSQVRSEXDAXLLXEARXXXXXXXRMXXEQYXALRRKIGGTYXDFFKSYVEVDGXYVEEGWVDKTCKXCKKDTXGEXRQVDXLGRYXHVACXEXXXXXNFFXXXFXR

SEQ ID NO: 30550 - protein, 323 aa, Artificial Sequence
  Synthetic consensus sequence
  misc_feature (1)..(242): Xaa can be any naturally occurring amino acid
  misc_feature (244)..(245): Xaa can be any naturally occurring amino acid
  misc_feature (247)..(250): Xaa can be any naturally occurring amino acid
  misc_feature (252)..(254): Xaa can be any naturally occurring amino acid
  misc_feature (256)..(256): Xaa can be any naturally occurring amino acid
  misc_feature (259)..(260): Xaa can be any naturally occurring amino acid
  misc_feature (264)..(264): Xaa can be any naturally occurring amino acid
  misc_feature (272)..(272): Xaa can be any naturally occurring amino acid
  misc_feature (274)..(275): Xaa can be any naturally occurring amino acid
  misc_feature (278)..(279): Xaa can be any naturally occurring amino acid
  misc_feature (282)..(286): Xaa can be any naturally occurring amino acid
  misc_feature (288)..(289): Xaa can be any naturally occurring amino acid
  misc_feature (292)..(292): Xaa can be any naturally occurring amino acid
  misc_feature (294)..(294): Xaa can be any naturally occurring amino acid
  misc_feature (296)..(323): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXFXXEXXXXLXXXTXSLXXLPLXLPPLPPPXPXXLLXXPVXXXXXLXXLAXFXPXXXXXXXXXXXXXXXXXXXXXXXXXXXX
